United States Patent 11,116,804 (MODULATION OF THE GUT MICROBIOME TO TREAT MENTAL DISORDERS OR DISEASES OF THE CENTRAL NERVOUS SYSTEM) - sequence listing, part 3

SEQ ID NO: 2246 - DNA, 23995 bp, KLE1738
ccccggaaaaagcagggccgccggcccgacgaccgtcggtaagcccggtcccgccgccgtgccacacaccattcacctggacgcagcgcctctgcgcgcaaggaggttattatggagcaaaacatcactaccctgcaacaatggatcgacgagagtgacaacatcgtctttttcggcggggccggggtctccacggaaagcggaatccccgacttccgcagtgtggacggcctgtatcaccagtcctacgcctatcccccggagaccattctcagtcactccttctttgcccaaaaccccggggaattctaccggttttatcgggaaaaaatgctcatccagggggcgcagcccaacgccgcccaccggaaactggcggagttggaacaggcgggaaagctcaaggccgtggtcacccaaaacatcgacggtctccatcaggctgccggaagcaaggtggtctatgagctgcatggctccaccctgcgcaattactgcacccgctgcaagaaaaaatatcccgtctcttttctgctggaaaccaccggcattccccggtgcactgagcccaactgcggcgccatcgtccgccccgatgtggtgctctatgaggagggactggaccccgatgtgatttccggggcggtgaatgccatccgcaaggctgacatgctcatcatcgggggaacctccctggtggtctatcccgccgcgggactaattaactattatacaggaaataagctggtgctcatcaacaaaggccagaccagcgcggacaccatggccaacctgaccatcaacgcccccattggtgaggttttctcccagatcaccgtgggtctctgagtccccggcagcgttcccccaaagggaggttttttccgcgatggacattgaactcaatattttgcaaaactggatacaggaaagcgacaacattgtctttatctccggcgccgatctctctgcggaggcaggctttcccgactatcgaatcatgacgcaggcggactgggcacggtacaaatacgcccccgacgaaattctccgcctgacctttctccagcgcaaccccttttacttctaccggtactaccgggaaaaaatcctggcccctgtgctcaccgcccagcccagcccggcccatgaggccctggcccatctggagcaggccggcaaactccgggccattttgacggtaaacatcgacggaatccatcaggaggcgggcagccgggaggtattggagcttcacggctctgtgatgcgcagttggtgcgccaagtgtgaaaagtttctggactttttctacatcgccgacagccccacccacatcccttactgcaatgtggatatgtgcggggactatgtgcgcccggccattgttctaaaagaggaaccctatgatctggccctgttggaaaaggccttggactatgtccgggccgccgacgtgctcatcatcgacgggtccgctctaaaagagtttcccgtccccaacctgatgcaggcctaccagagacacaagctggtcctggtcaacaccgcccccctggtctttgacgcccgggcgggcatcgtcatccgcaatcattcttttactgatatttttcagcagatccattggacccggtagcgccccgcagggccgccggcccaagaaaccccaccgcttgaagaggaggaatcccccttggaacagaggatagaacatgacaccatgggtgaagtcgcggttcccgcggacaaactctggggcgcccagacccagcggagctttgaaaactttcccattggagaggagaagatgccccctgacctgatccacgcctttggcgtcttgaaggaggcctgcgccgccgccaaccaccgcctgggcaccctggacacacgccggtaccagctgattcagtccgcctgccaggccatccgggccggggagctggcagaacagtttcccctgtctgtctggcagacaggcagcggcacccagaccaacatgaactgcaacgaggtcatcgcccacgtgggcaacgcccaggctggggagacgctgctccatcccaacgaccatgtcaatctgtctcagagctccaacgacaccttcccctccgctctgcatatcgcggcggtcaccgccctgcatacccggctggagcccgccttgaccgagatgctgctctgtctacagcgcctggagacagacaaccagaccgtggtcaaaaccggccgcacccatcttcaggacgcggtgcccatcaccttcggccaggaaatcagcggctggcggtccatgctggagcacgcccgggacatgatccgcgcctcactggcaggcctgtatgagctggccttggggggaaccgctgtggggacggggctcaacgccccgccgggctttgacgctgcggcggcagaagaggtggcccggctgaccggcctgcccttccgcccagcccccaacaaattccacgccttgtccgcccgggacgggctggtattttcccacggcgctttgaaggccctggccgccgatctcatgaagctcgccaacgacgtgcgctggctggcctccggcccccggtgcggcctgggggaaattttcatcccggaaaacgagcccggctcctccatcatgcccggcaaggtcaaccccacccagtgcgaggccctgaccatggtggcggtgcaggtcatgggcaacgacaccgtgatgggcgtggccgcctcccagggcaactttgaactgaacgtctatctgccggtgatgggatacaactacctccagtccgtccggctcctgtcggacgccatgcgttccttcacccggcggtgcctgtccggcctgacccccaaccgggagaaaatggcggaaaaccttcaccgctccctgatgaccgtcaccgcgctgacccctctggtggggtatgaaaacggggccaaaattgccaagctggcccaccaggaagacctctccctgaaggaggccgccgtccgcctggggctgttcacccccgaggcctttgaggcggccttccacccggagaccatgatttgaccttgattttaagacagaaaggaccgtacccccatggacatccgcgctgcatcgttggctctgcactaccgcctccagggcaagctggagatggtctcccgctgccccatccagacccaggaggacctctccctggcctacacccccggtgtggccgccccctgcctggagattcaaaaggaccctgccctctccttccagctcacccgccggcggaacctggtggcggtgatcaccgatggctctgcggtgctgggcctgggagatatcggtcctctggcgggcatgcccgttatggaagggaaatgcgttctgttcaaggagtttgccggggtggacgcggttcccctctgtgtggacacccaggacgtagaagagatggtccaaaccatcgccctgatctccaaaagctttggcggcatcaacctggaggacatcgccgccccccgctgctttgaggtggagcgccgcttaaaggagcggtgtgacatccccgtctttcacgacgaccagcacggcaccgccgtggtcatcaccgccgccctcaccaacgccctgaaggtggtggggaagaagaaagaacaggtcaaggtggtcctgaacggcatcggcgccgccgggggcgccgccgccaagctgctgctggacctggggtattccaacctcatcctatgtgacaaggatgggattctctgcgccggggaccccaccctgctcccccaccacgcggaactggccgcccgcaccaaccaggcaggacagcggggcaccctggcggacgccttggtgggcgctgatgtcttcatcggcgtctcccggccgggcctggtcaccggggagatggtggagtccatggccaaggaccccattctcctggccatggccaacccggtgcccgagatcatgccggacattgccctggcccacggcgccgccgtggtgggcacaggacggtcggactttcccaaccagatcaacaacgtgctggtctttcccggcctgttcaaaggcgcgctgtcctgcggcgcggtacagatcaccgaggggatgaagcacgccgccgcccgggctctggcggacttggtccccccggagcagctctcccccacctgcattcttccctcccccctcaaccgggccgcagcggaggccgtggcccacgccgtcgcggaggaagcccggtgcaccgggcatgcccggttttaattggaaaacggaaaaccggcgaaccagagtttttggttcgccggtttttgttctctattttctctccccctgtctgtcacttcaccacggtctcacacagccgcatgagaatggtggccacctgggcgcgggtggcgctgccctggggattcagggtggtgtccgtcaccccggtgatgagcttctgggcattggcccaggccaaagcgtccttggcgtagccgctgatggaggcggcgtcggtgtagcccgacaggtccgccttctggctcacgtcatagcccttgtaagcggcataccggtacaggatcgccgccatctgctcccgggtgatggggctgttgggggcgaaggtggtggcgctggtgccgttgacaatatcattggccgctgcccaggcaacggcatcggcataccaggcgccgttctccacgtcggtgaaggcgctgccgccggacaccgcgggctcgttctccagccggtagaggatggtgacaatcatcccacgggtggtggtggaggcaggggcaaaccggtccgccgacacgccggtcatcatacccttgtcgtagacatactggactgcctcatagaaccaatcgccgctcttcacatcggtgaagggcagggtgggtgtcacggcgttctcggtccacttggcgtacaccgtggtgttgccgttcagcttcacggaggtgaccttctgggtcagggcctcgtcgctgtaccagccggcaaaggtgtagccctcccgggtgggtacatactgctccaggtccacggtggtccccttctccttggtcaccttggcaatggcggagccgccgttggtgtcaaagctcagggtgtacttggtggtgacggaaccgccgcctccgccagaagagctgtttttcgagaatgtcgcagtgacggtacagttttttgtcacattcttgactgtgtaggtcccctccgcctttcgctccacaattgctccgccatcaacagtcacactggagatggaatatccgctgttggcaatgacggtgaagtcctggctaccgttctcggcgacagccaccttgccgctgggattgatggtgccgccttcactggcagttgtggtgatagtgtagccagctaccgggtctgctgtgccgtccccaacataggctcccccggaagaaacgctctccttttcggccgttttgcccttatagttcaaggaaactcccaacgcgccattttctcccgagcctttattatccacgatcttaacagggaacgaaccacttttattcggttcactgccgttcttcgtggtcacaccaagggcaatatcactttgatttccgctcccgctaaaggtacacccttcaatagtcagagatttgatgctggcttgtgcgcctgtgatatcattggggtttgttccgtcatctttaccacgagcacacactttgatagcggacaagacgagtggaccgcgttcaaaagtactgttggtaatggagatttcggcgttctgaacagcgaccaaatttagatcaactatatagccaaaagcgccgcctcctgtaaatttgcagccatcaatcttcagttcttttgcattggtcagatacaggcattgctttatgtaattctggacttcgcagttgttcatggtcaggatcaggccactgacaacatctttattttgctccccagaattaacagcaaaatttttgacttttttgttgctattttcgcccgctccgcttccgtctaacttcaagttattcagcgtgagggtcgtgttggtctggttagcattttcacccgaatctaccgcacagctgatggtgccgtacaaggtcttgttgttaccattgatggtgagggtgcttcctgcggagagtttaatatcttctcttacgtcctgctgcagggtaacttcgcccccgctttcaatggcggcatctagtgcggtcttcaaggagatatagccatcctctcccaccttggccacaaagtcagcatcggttcccaggtcgcccttttcggtctttgtggcagtttcatttgcggaaagttcaacggaaggaatggcttcctcgttcgccgccagataagcgagttccactttaacatcagacgctgcttctccctctccggcttttacattggagatggtcaccgggaatgcgcccgtagagggagcggcagcgccatctgtcccctttccctggctacccaactgaatgatagcattggtgccagagaaggtacagccggagatattgacactcttaatgctggcagccggagtatcagcactgtctggcagtttcacatcggtagccacatcatccgcgccgttgcgctggttcagtttcagggcattcttcgtatagtttccagtaaaggtggagttggtgatggacaccacagaattctgaataccgcacaggttccagttgataccgtatttcagcctgctcgtaccagtatcgaacttgcagttgtcaatcgtcagggactggcagttgggcaggtacataaacgacgagtttctctgatcattcgccgtattgccatagaactcacaccactccagggttaggtgcagtttggggggcttggccctgctttgcgtgttcgtcagggcaaacgtgtcatactgtgctgaattgtctgcaagggtatcagcatcggtattcttagtgccgaagataatggggttcccctctgttccctggatggtcaagtaaacatcttcgccgttcttgtcattctctttcactgcggcgttgtactcctccacagtggtgaaggggttgtccttggtacccttcgcagactccgttgtgccctgatttccctccacagatgcagaatcatcgttcgtggtgggctcttgaggggttgccggttctgtactcgccactggctcattttccgtagaagcaggctccgccgcaaatgcaaccggggccagggtcagcagcatgcacaggcacaggaatccggacaaaagtcgtttcttcattggtttgttttccttcctttctgattttatttggggttcgcgggtgtaaaaagcagagcaatcacccccacattttcaaaaagtgtactttttcaggcaaaaaataattgccccatttcccccaaaaatcttgcaaaaaaggaaaaatgcatgtattattttaataggtacttttcctataaagtaatttgaaaaagtacaccttttcaaattctctttctctccccgtacggatgaaatttccttcctcctgcgggagtttttttttcagaacacgttccctgccctgcaaaagcacaaagaagcccccgccgggtggcgggggcttctttagggcgtctgtatcttcaaactcagcttcaacaaataggaccgcgggtcctctgaggcaatgtcattcaccaggtcctcctcatacaggtctccgtcgatggcatacccctgcgccagcacccagtcccgaagccggcggcaggcgccatattcggaggcataggagccctggtggtagagaaccgcatacgtcccagctgggcggacccggaggggccagccagtggttcccggggggaccagacagtaatagtagtcctccataaaatcccctctctccaggctttcccggcagatgatgtcccccggggcctgggaggggctgccgttttcccgggcccaggtaatcagctgccgcacatggaggaggtaaaccgcctcctcaaattttgcatgtgcaaaatccggcgcctccaccaccgcacagtgggcctccggaaaggtctccagccgaatctcccccggccggacggtctgggccagcgccattttgtccttggcgttgtgcaggaaggcccccatacgggccaggcgccggcgctccgcctcccagtccgcctccttttcccgcagcaggtccatcagggcctccgggctccggcgggtcaggtacgaccggatctccgccagaggggtccccagacggcggagggtggcaatgaggtcataggtgggaatctgccgggcggaatagtagcgatagccattctcccccacccattggggcttgagcagaccaatgtggtcatagtggagcagggtgtccttcttcaccccacacagggcggcaaattccgccgttttgaaccggtgtttctccattttgcagcctcctgaaaaaaaaaggaagaacccccttgactctggggttactccatagtttatccttagtatagcaaacagaaatcccgtccgcaaggaccgaactttgatttgaggtgaattcgcttgtctaccccgcgtcattcctggaaaacctttctacactatgtcattccgtccgtgtccgccatggtgcttttctcggcctataccatcgtggacggtatctttgtctccaagggcgtgggcgagttggccctggccggcgtcaacatcgcccttccgtttatcaacgtcctgtccggtacggccatcctgctctccatgggcacctccaccctgtgcgccttcgccctggggcatggggaccatgagaaagcggaaaaaatcttcacccagacggtggtggccatcgtggccatctccgcggtgattaccgtggcggtctccctgttctcggaaccgctggccgttctgttgggggccggtccccagacggtgggctactccgcccagtacctgcacatggtctgcctgttctccgtctgcttcatcctctcctactgtctggaggtcatggtgaaggtggacggcgcgcctcagctggccatgttcggcgtgggcatcagctttctcatcaacgtgggcctggactacctgtttatcatggtcttccactggggcgtctggggcgccgcgctggccacagggctggcccagctgggcagtttgatcttctttttaatctatttcctgtcgggaaaatccaacctgcgcttccgccggttccggtttcgtctgaaagacttccggcggattctccccctggggatcgcggactgctccattgagctgatgctgggcttcttaacccttctgtacaaccacgtgatcacccagctgctgggagagagcagcctgcccattttcgcggtgatcgcctacctgagcctggtggtctccatggtgatgcagggcatcgcccagggtatgatgcccctggtcagcctggccgtgggagaaaatgaccggccctccatccgcgtctatctccgaaaggcccttctctccgtcctggtgatcggcgtgttggtggagctgttctgccaggccgcccccggcaccatcgtctccctgctgctgagcggagacagcgccctctttgacgagaccgtctccgccctgcgtcaatacgccctgtcctatctgcctgcgggcctcaccattgtcctggccggctacttcgccgccttgggcaaggccggcgcctccgccctgctctccctgggccgcgggttcctcctgctgccggccgccctcatggtcctctacctcctgggcgccagcgccatgatctggaccgccgccctcattggagaattgctgagcctgggcctgggcctcttccttctgcggcggaacgaagctgcagccaaaaaggaactggacacttaaagacagcgtcccataaaaacgcagcaaaatgtgcgaaggaaccggcgtgtacaatcacgccggttccttcgcattggagaatttccttccggtttcccgcagcacacgaatggtcccaagtgtcagtaccagtcatgcttttccttcctgtccaacgtcgcgatccgctccatctccctctctgtcagcgcaaagtcaaaaagggagagattctcccggagatgctctggatcactggagccaggaatcaccaccacacccttttgcagattccaccggagaatcacctgcgccaccgttttcccatgggatgcggcaatttccttgcacaccggattattcagcagagccccggtgaagccccgtccccccagaggataccatccctgcacaacaatcccccttttctgaatgtgctccaccacagggcgatcctgatagaagggatggatttcattttgaatcagtgccggcttcatggatacctttggcaggaaagcatccatctcgcggatataataacaggaaatcccagctgttcgtacctttccctcccggatcgcttgctcaatggcttggtatgccgtcacatcatcggatgcgggatggtgcaggagcatcatgtcaatatatccaatatccagcttgctcagtgcctcatctatcgcctgttccgcgtggctgtactggttcggatacagctttgtttgcacaaagatttctgaacgggaaaccccggattgccggaccccttcccccacttcacgttcatttccataaaatgaagccgtgtctatgagacgatatccactttgaactgcttgatacaccgcattgacgcaggcatctccgtgcagagcataggttccaagtcccaccacaggaagcatgtgcccactgttcagtctgaccaccggagccgtgccgtttttaccgtttttgagatcaataatcatggttttccctcttctttccctgctgatctactccattttacctatcctcccgttccaacgccaaacacaccggtttctgctccgttggaagcccaccaagagaaccacgtatgattggtttcagcgataggatttctcaaagatgtccgcgcactcctcgtctgtcatttcacagggattggccaggaataagccgcccattgtttctctcgcattgactgccagcctcatggactcgtctggagcaaacccataatcgctcattcgcagatcgtccaccccacaatccttctgaagctttaccaatgctgtgatgaagtcctccggcttgtccgcctctgggattcccatcgcacgggccattttgataaactggccatcgcaggcgtgtttctcaataaaaaattccgaaaatgccttggatatcataatcagccccgcgccgtgaggcagattaggatggtatgcactcatggcatgctccatggcgtgctgcgcggtggtgctggtaagctgcatggcaatgccggcaatggtgcttccgtaggccacgtgttcccgggcctccagatcctccccattctttaccgcaagaggcagatattttgcaatcctttcgattgcagaaagggcaatggtttcgctgataatgttcacaccgttggagatcataacctccgtgttatggaaaagcgcgtcaaacccttggtaggccgtatattggggcggaacagttttcatcagttccggatcaacaatggaaagaaccggaaccagccccggagccccaaacccaattttctcgtgcgtatccaaattcgagataacaccccaacagttgatctcagaacctgtgccggacgaagtgggaattgtcacaatgggaagtcctggattcaccaggggctttccttttccggttccgccgcttacatagtcccacagatcaccgggatttgtcgccattgcggcaatcgctttggacgcatccaggaccgcaccaccgccaagcgcaaggataaaatcacagccctgttcccttgcaaaggcagcgccttccataaccacctctttccgcggattctccataattttacgaaacactgtatatgcaacgccggcctctgtgagctgttgggttacgcagtcaaaggaaccgttgaccttcgtagagtttccattggagagtagtagcaaggctttcctccccggcatcttctgccttccaagttccatacgtgtcccacgcccaaaaatcaaatttgtaggattattgaagtgaaatgccatgtgcatcataaattcctcccaaagttctccttttctcatgctgtggagcagatactccaggcagtcctgttttgccttacatgaaccccatctaaaaaatgatgttctacgcaaagaaagccgctggaattgtgcctgcgcgcgcctgcttgctgctgtttcagatatttttgtgcttcctcagcgcccggcttgccagctgagaacattcgttaccttctccggtatctccttccctcccccaccgtttgggggctttttcattataactttgccctaacgaaatagcaaatacctaaaataaacacattcatttgctttacgggcatatcataacatgttatactcgtacacacacaaaggaggtggcaccatggaactcagggtacttcgttactttatgacaattgcccgagaaggcagcatcacaagcgccgcaaatgttctccatgtcacacagccaacgctttcccggcagatccgcgatttggaaaatgaactgggccagaagttattcatccgtggaagtcatcatatgaccttaaccgcggaaggtatggttttgcggaagcgtgcggaagaaatcctctctatggtcgataaaacagaagcagaatttcacgcgatggaaagtacggtcagcggagatatttatatcggcagcggagaaacccaggcgattcagcatattgcagaaattgcaaaggagatacgggaagaccatcccggcatccattatcatctgtacagcggaaacgcggaagacgtaaccgaacgtttggacaaaggattgctggactttggcatcctaattcagccagcagacatctccaaatatgactacatcaacattcctgccaaagacacctggggtgtcattgtgcggcgtgacagccccttcgcagaaaaaacgtccatccgaaaagaggatctgctgcacgtccccttaatctgttcccggcaggccatttccaagagccggcaaaataatgagtttacagcctggttcggtgaagattttgagaaactggatattgtgaccactttcaacttggtttataatgctgccattatggttgcgtcagggctgggttgtgccgtcacgattgataaaatagccaataccacagaaagcagcaatctctgttttcgaccgctggaacctcgacttcactctgggttaaatatcatctggaaaaaacatcagattttctcctccgcagcagaagtattcttagagaaacttcgtgaaaattttggtagcccctctctctgatcccttgcctgccaaggggaatgtcatatgtccccgtgattgccacagccgcgtgttttatagacgcagaaactctgaaccgtgcagaagaaaaacgctctgtaaatggatatccattcacagagcgttttctcattctgccttctcttactcaaacatccccgctgacgcggggatgtttggccgttctatcaagacagtccctttatttgagctgtttgcgcatgtaataccggtcaaatcccttttcctggacccggtcatagatcacatagcctcgttggcggtaaatttccagggtccgctgatacttgacatgggtatagagacggcattccgttttaccccgggcacggaggaaggcctcgcaatggtccatgagtcttctccccacgccggtccccttgggccaggcggccaaaacatccatccacatgacctccccatctccatccttgatgagaaggtagcccagaatgatctccccctgggccgccacaaacaggaaatgctccttccttgcctggcagtagtcctccagcatagggcccggcgtctggccgatgagaggaatatagtccttgaacgcggccacgcagcaggcgcagaccccgggaatgtccgccaaagcagcccgtcgaatttccatggctttcttccccccctgtccgtgcagaccctttacaggtcgcaggccaccaggtccgcaaaggtctgccggcggaccgccagccgggccttgcccccccggaccatcaccagcgccgggcggcagagacggttgtagttggaggccatggtaaagttgtaggcccctgtggtgagtaccgccaaaaggtcatcccgcgccggctgcggcagagagaccttctcctgaatcaggtccccgctctcgcaacaccgcccggccacagtgcacagaaaatctcttgtctcccccatccggctggccgggaggaccgtgtaaggggcctggtaaagggcatagcgggggttgtccgtcatgccgccgttgacggtgacataactccggtaccccgcaatggtcttgacccctcccacccggtagagggtgaggccggcattggccacgatgcttcgtccgggctccaaaaggacccggggcatcgggtagcccttggtctcacagccccggcgcagatggtctgccagggcccggatattgccggggatatccaccgtagggtcgctctcccgataccgcactccaaagccgccccccaggttcagggttcgggccacaaagccatgggcctggcgcatggcgtgggcaaagtccagcaaaatgtccaccgcgtcgcaaaagggcgccgcctcaaagatctgagagccgatgtggctgtggaacccctccacctgcagatggggccgggacagggcgtccgccacaaactgggccgcctggccggtctcaatgggaaccccgaactggcagtcgatccgtccggtgttgatggcctggagggtgtgggggtcaatcccgggggttacccgcagcaggacccgctgccggtgactccgggcgccggcggcctgctccaggcgctccagctcctggtgattgtccacgatgaagcaccccaccccgcagtccagggcatacgcaatgtcctcatcggtcttgttgttcccgtggaaatagagtttctccgcgggaaatccccccgccagggccgtgtaaatctccccgggggagaccacatccgcccccatgccctcttcttccagcacagggtagaggcccttgaagcagagggcctttccggcaaacaggggcagggagcccccaggcatccattccgccatcgcctggcggtaggtccggcagttggcccggacctggtcctcatccaacacatacagcggggcgccaaactcctccgccagggccaccgtatccaggccgcccactgtcagatgtccctggtcgttgacccccaggttgtcatatagcatcgtcatttccttctctctccgttcacggtcccagcaggtcctccatgtgatacagccccgccggctgcccctggagaaaatccgccgcagccagggccccctccgcgaaaagcgcccggtcatgggcctggtgttttaaggtaatggtctggttgtcggtggcaaaaattacctcgtgctcccccaccacattgcccatgcgcagggaatgaatcccgatctcattgggctggcggggatggtgccccgcgcggccaaagacatacgccgcgtcaggccgccgggccttcaccgcatccgccagcagaagggcggtgccactgggggcgtcagcctttcggttgtggtgggcctccacaatctccacgtcacagccgccgaaaatggctgcggcctggcccaccagacgggccagcagggccacgccgatggacatgttgtaggactgaaagaccgggatcgtccgggccccttcctgaatccgctgaaactcttccggcgtataccctgtcgtggccgccaccaggggtaggccccgttggacacagtaggccatgagttcctccaccccttcgtggttggagaaatcaatcaccacgtcggcgggccctgtgtagtctgccagacgggcatagcagccgtcctggccggaacggtccaccgcggcggccagccggtgtccgtcctcctgcagcaggcggcagacctcctggcccatgcggcctcgggcgccgtttacaatgatgtccatggtctcctcctctctcaaaccgggagccccagctcccgcatccgctggagcatcccctgatagtggtcttcctccatgggcaccaaggggaggcggaggtagttgtcgcaataccccagggcagccatagctgccttgacgggaatggggttgctctcacagaacagagcacggatcaggggcatgtatctgcactggagctgggccgccccggccacatctccggcgaaaaaccgctgggtaatggccaccgtctccgctgggatcacgttggacagcacggaaatgcagccggcgccccccatggacaggatggggacaatctggtcgtcattgccagagtaaatgtccagccggtcccccaccagggagaaggtctccacaattttagagatgtcgctgttggcctccttgatggcggcgatgttgggatgctccgccagcttgacataggtggccggttcaatgccaatgcccgtgcgggaagggacattgtagaggatcaccggcttggtgctggcatcggcaatggtgttgtacatggtcaccaggccccgctgggtggtcttgttgtaatagggcgtgaccaccaggaccgcgtcggccccgtcggcacaggcgcttttggtgagctccaccgcatagtcggtctcgttggagcccgtgccggcaataaccggcacccgtccattcacccgctcacaggcaaaggcaatggcccggcggtgctccgcgtcggtcagggtggagctctcccccgtggtgccgcagatgaccagggcgttgatcccctgctgaatctgccagtcaatcagtctgccaaagcggtcatagtcgatcccggtgggggtggtgggggtgatcagtgcggtggcaatgccgcggaagatgggatggttctgtttcatgataggttcctcctgcatattgaaatgtcctgcccgatctccctgcggcccaaaaaagcaacaaaaaaatcaagcaagctatgcggggatagctgcttgataacataaggcagaccgctgacggtcgtcagaggtcttgatatcaaggatagccctccgcaaatttaccatttgcgacagtcgggtaactcttagttcacccgcccagttcggccctctttgcagcgaagaccgccttcggcgtccacccctttccccggccctgccctgcaaggcattggcaccgggtactcttgatgcaacgcgcctctatctctggtttgtcttatggtatgtgatttctcccggtttgtcaagaggaaatccctgtttttttccacaaaatctcccgcgcttctcaccataatcacaaatttcgtgacaaaaaaaccatcttatgatacaataaagccgctcattttttgtagtatgcgacgacacaggaggtgtttcccatggatcaattttcgaaggactttggcggcctgcactcccccgacgatttcgacctgctctccctgggcctggttcccggccaggaggagcaggcagagacagcggaccaggacgagccgcggatcaaccccctccacgatatggacagtctggagttcctcctctgggtggagcaggaggcggagcgggagatggcccgccgcaaaggacaggcggcggaacccgccccggcgcaatccccagaaaaaaccggcacggtctaaacaggccgtgccggtttctctttcttcttcgtgatgactattatagcctcttcacaaacagtgcccggatggcgttgagcaccgcgagaatcataacccccacgtcggcaaatatggccagccacatgttggcgatacccagggcgcccaggatcaggcacagccccttgatgcccagggcaaaggcaatgttctcatagacaatccgcaggcacttgcgggagatgcggatggccttggcgatcttcatggggtcgtcgtccatcagaaccacatcggcggcctcaatggccgcgtccgaccccatggcccccatggcaatgccgatatccgcccgggagagaaccggggcgtcgttgatgccatcccccacaaaggccagcttcttttttgccggcttctgctgcagcatctcctccaccttggccaccttgtccccgggcagcagttcgctatacacctggtccactccaagctcctccgccacctgctgggccaccgtgcggacatccccggtgagcatgaccgtcttttccacccccgctccgcgcagggcttccatcgccgccttggcggtgggctttaccacatccgcaatcagaatatgtccggcgtacgccccgtccaccgccaggtgaatcaccgtccccacctgatggcagggcacagccgcaattcccaggcgcgccatgagcttgtcgttgcccgcggccaccgagattccgtccaccttggccaaaaccccgtggccggaaatctcttgcacctccgtgacccggctccggtccagttccttgccataggccttctgcaggctcttgctgatgggatgggaggaggcgctctccgccagcgcagcatactccaaaagcttgcgctcctccatggcggcgtggtgaatccccaccacttcaaagaccccctgggtcagggtcccggttttgtcaaagaccacatagccggtctgggacagggtctccaaatagttggaccctttgaccagcacgccggccttgctggcccccccaatgcccgcgaaaaagctcagaggaatgctgatgaccagggcgcaggggcagctgatgaccaggaaggtcagggcccggtaaatccagtccccccatgcgggggccagccccaggcccagcatccgcaccaagggcggcagaacggccagggccaaggcactgtaacacaccgccggggtgtagacccgggcaaacttggcaatgaaatcctcagaccgggacttccgggagctggcgttctccaccaggtccaaaatcttggagaccgtggactccccaaactccttggtggtccgaatggtcagcaggcctgtcaggttgacgcagccgctgatgatctcatccccctcccggacgtcccggggcaggctctctccggtgagggcactggtgttcagggtggagactccctccaccaccacgccgtcaaggggaaccttctcccccggctgcaccaggatctccgttccaatctccacctcgtccgggtctacctggattactctgccgtcccgctccacgttggcgtaatcagggcgaatgtccatcagctcgctgatgttccggcggctcttccccacagcatagctctggaaccactcgccaacctgatagaagagcataaccgcaatggcctcggtgtagtccccgctcttttcatacagggccagggcaatggcccctactgtggccaccgccatgagaaagctctcgtcaaagacctggcggttgcgaatccccttccccgccttgaggaggatatcatacccgatcaccaggtagggcaccaaataggccagaaagcgcaccacaccggtgaggggtaaaaactgaaacagaatcagcagcgcggctgccgccaagatgcgggaaagcatcaccctttgttttttattcatgcttacacactccttttccctcttctgttccatcgccctcccgccgtgtggaccagcgggagggcgatgacagtctggatgggaggcttacaggaagacttcgcagtcgtcctccaccttcttgcagttgtcccggaccgcagtcatcaccgatttggggtcctgcccctcttcaaactccacatgcatcttcagcgtcataaagttcaccacagcggatttgacgccaggggttttgttggcggcatcctccatcttgttggcgcagttggcacagtccacatcaatcttgtaggtctttttcatctttgtttctcctttccagaaatgctctgcatcatatatttgagcatttgttcaactgttatgtccacatcatagcacccttttgagaaatgtcaacggctttcccgcttctcctcccgtttggagcgaaaggatttccaaatggagcaaagggctccggtcctattgtatggtctgccccatttgtgatagaatagcccaaagatttcaaaaaggaggccatggccatgcatgcggattggattcaatccatagaacgccagctggcggaggtgcccccgggctgtctgctggagtcccccgtctctcaggtgcccaggctccaccgccccgggccccactgggccggccgtggacgggtggaaaccttttccctgtttcccggcctcaccctctcccatctgtgtttccaaagcgagaccttttctcaccggcatgccgccctggactccggcctggaaatcacccactgccgccgggggcgggtgggctgggagatgaaggaggggctcaccctctatctgggccccggggatctctccctgcaccccatggactgctgcgcccactccaccctccgctttcccctgggatactacgagggcttctccatctccctgaacccggacaccctgtcccaggctttgccgcccgccttggccctgggcggcgtctccccccaggaaattctgcggcggttttgtccccagggccaccccatgtctctccccgcgcagaccgcgctggaccatattttctctccgctctacgatctgccggaggccctccgcctgccttactacacgttgaaagtgcaggagctgctcctctatctctcccagcaggcccccgccggggaacgggcctccaaccagtatctctcccaacaggtggaaatcatccgcgccattcacgaccagctgatggcccatcccaaccaacggaccaccatcgaagccctggctaaggagtatcacctgaacacctccaccttgaaagcggtcttcaaagcggtctatggccagcccatcgcctctcacatgaagcaccaccgcatgcaggaggccgcccgcctgctgcgggagaccgacctgagcatcggcgacattgcccaacaggtgggatatgaaaatcagagcaagttttccaacgtctttcgggacatctttcaggtgctccccactgagtaccggcggcagcaatcccgtgacagtaagacagagggacgtctttgagaaagacgtccctcttgttttttattccctacttcgtttcccgccgccgggcatacagaaaggatgcagctgtgggaatcagcaccagaaccaaaatcacaacgaactggagcgcgggcagccgcaggaaagtcagcgccagaatcaccaggccgccgatggtccagaccttgcccgccagccgatgggtataggcccagttgtcctcgtcagccagggtccagggcaggcgaatgcccacggtataggtctgtttgcacttgggcaggtagttgcccaccaccaagaacatcaggcccaggaacagacctcccaccaggttaatgtccaccggcagcgccagggccttggcataggtcatagtcccgcagaacagcgagaccagagggcaaatccacagcagtagtccgaagggtttggccgcaatattcttccccttgggatcggccatagtcaccaccagcagcaacacctggagcgccgccataagcagaggcagcccaaagacaacaaaggccttgccggcgtagttgtccgcctgcccgttcagtccaaaatgaatcgggacctggtccggcagctgattccacaagaacagtcccaaccccatgggcagtagaatcacaagcagggacagaatcagcattccctttctctcccgaatgagattattcatcctcttttcctcccttcagttccgaaaaccaaatcataatctcctctaacacagaagtgttgagctcataaaaaatgtattttccctcccgctgatctcgaatcagatccgcctccttcaatacagacagatgccgggaaatggcggcggcagtgatggaaaacgcctgggtaatctctcccgcagacttcttgccgtgtttcagcaggtttaaaatctcccgccgtgtggggtccgccagggcccgcagggtagcttggatccccatgtaatcctcctttcttttcgcaaacaattaacatttaacttaattgttaatcgaatgatacctctgattcctccttttgtcaagtagaatcctcggtgttttcctccaaatggcccccgtttttttcttctaattgcagcaaaaacaccaccgtctccccgattgggaacacggtggtgttttttcagaaggtcagtgcaggtagttcagcgggtcaatggccacgccgtactcccgcatggaaaagtggagatgactggcgtccgcgctttccgagaccgccgtggtgcccacggtgccgatcaccgtgcccgcctccacttccgtgcccggctggacgttcacggactcggccaggttggagtaaacgctctccattcccttgccgtggtccacggtgacggtgacgcccatcatgtcgtcggtactcacgtcagtgaccgtccccttggcgcaggcggccacaggggtccccagctcggcggcaatgtccaggccgtcatgggtccgccagtctcccatggtggcgtcgtaggcaaagacctccaagctgaaatcccgatccacgttgccctcaatgggccagacgtaggccgaagaagcggctgcctcctcatcgggggtggtcttctcctggccagcggtgtcctgtttggactccgccgatttctcctcctccgtggcagaggcggcggcaccgtcctgggcgggcggcgtggtctcctcggtttgttgccccggattctggtccccttccagctccgcctgtccgctgaccacggagctgggttccgacccgaatccctccggctcggcaaagagcccgctgaacaaataatagcccgaaattccaattgcggcgatgcagaggaacaggactatgtagaagcccttgccctccatgaaatcgcccagcttgtgctgagtaggtttttgtttcataaagaaaccctccatgcgctgtacgtgaattctcgaagcctttctctttggaaaggttgtctccgaagcctattcttgacagctggagggattcttatacgcttttttcaaaaatttgtctcaccgagaactgccgcggaggggggcccgttctcccttgcctctcctctacacgccggttaggtcaaacgcagggatatattccgcccgggcggcctcctctccctggaagaaaccgtccagagacaggttttccagataggccatggcagcccttgcctcacgcttccgcagccgccggtccaaggggggaaattccgccgcccggccccaggggatgtactgactcatcagggaaaagagcacggtgtggggcgggaaggtcgcccgcacccagtccatcacttccttggcctggttcagccgtcccggcagaagcaggtgccggatgaccacccccctttgcaggatgccctcctggtccaggacgtaggggcccgtctgacggaccatctcctggatggcagcccgggcgacctggggatagtccgccgcccccgcccagcactgggcatcccgggcatcgggatatttatagtccggcagatagatgtcaacggttccctccagcgcccggagggtctccacccggtcatagcccccgctgttccaaaccacggggacgggcagcggttgggagagggcctccgccaccacgtgagcatagtgggtgggattgaccaaatcaatgttatgggccccggcgtcaatcagcgcccaaaagatctcccgcagccgttccacagagatttctctgccaaagtcccgctggctg

SEQ ID NO: 2247 - DNA, 16077 bp, KLE1738
tcccattggtaaaaaacggcccctgccgcagtgcggcgggggcccgcgtgtttctgttatggtgtgcccgtcaggggttccgggtcgcctaagtaggtgggctccggctggaagatggcccagaggacatccttgtcccgggccaggatctcccggaggtcccgcatggtctgcccccggtagttctgcccgtcggcagccacgccccaggcctccaggcccagggcccgggccaggtagagggcccggtacatgtgatactcctgggtaacaatgaccaccttttttaccccaaagatgtcccgggcccggtagaggctgtcataggtggacagccccgcgtagtccaggaccacgtccgcctggggaacgcccttttccagggccacccggtgcatggtggccagctcgttgtaatcctggctgcggttgtccccggacatgagcagcttgtccgcccagccggcctggtagagctccaccccccgggtgaggcggtcagacagcatgggggtgggggttccgtcggcatagacgccgcagcccagcaccaggatgcagtccaccgcctccggcggggtatcctccagggtgcgaaactgctgccgggtggagagaaccacgtagccgctgagcccaaagaccagggccgcccccaaggcacacaggattcccagcacggccaggccccgcagaatccatttctttccccggctcattggtctttattccggtgctggaagtagagcacccccgcgataaacacaatgccgacgatcagtccgatgaccatagcggcctcctttctctggcgcggagggaaccctccgcaggggcttattcttcctctccgtccagggggagctcctcatcctcttccagctctccccggacataggtcacccggaccgcggaagaactgagcatatccacccggtattcccgccagcctttctccgccagcttcgcgttgccctgctccaactgttcggtcacgtcctcggtgtccacaccggtgtaggtcactttcttctgttccatgttgcctctcctccttactgcccgtttccttgggccgctttcatcataatggcgcactcaatccgttttttgaacagctcgcatccgtaggtataggtcccgttgatgtccccgctggcgtggtaggcgttggccgcgcagccgccggcgcagtagagccgggcccagcagtcccggcagtcggggttggccaccacgttacatcggtggaatttctctcccagctgggggttggtgatccccttccatacatcccccatggagtaggcggggtcgttgacaaactggtggcaggggaagagctccccccagggggtcaccgccagatactccgtgcccgagccgcagcccgacatgcgcttgtgcaggcagggccccccctccaggtccagcatgtagtggtagaaggtgatgggccggccctcccgctcccgttttagcatctcctgggccaggagctcatattgctggaagagtttgggcaggtcctcctgggtgagggcccagggttcgcccggcgggctcaccaccggctccatgctcagctcggtaaagcccagatcggccatgtggaaaatgtcgttggtaaagtccacattgtcatgggtgaaggttccccgcatatagtaactctggtctccccgctgctggacaaaccgctggaacttggggacgatgatgtcatagctccccaccccggccaggttcttccgcagccggtcgtggacctccttccggccgtccaggctgaggaccacgttgtgcatctcccggttgcagaacgctgtcacctcgtcgtccagcagcatgccgttggtggtgagggtgaagcggaacttcttgtggtggatgggctcctgggtccgggcataggccaccaggtccttgaccacctgccagttcatcaggggctcgcccccgaagaagtccacctccaggttcacccggctacccgagctggcaatgagaaagtccagggcctgcttgcccacggcaaagggcatcagcccccggtccccgtggtagttcccctggctggcaaagcagtagtcgcagttgaggttgcaggtgtgggccacgtgcaggcacatggccttgagcacgggcttggtgtgttggaaggcctcctgctccacgtccttccacaggtcttgggagaagagcttgcccgcctgcttcagggcctggatgtccgccaggcagtctaaaatctccccctcatccacgtcgtcccggtggccgtacttggccagcatctgggccacaatctcctcctggggggtggtctcatagagggcaatgatgtcataggccacctcgtccaccagatgaaccgagccgctgtaaacatccaggacaatgttgtagccattgagcttgtattgatggatcatatctgttttctcacttccgtcgaatgaaaaaagtgccgcttgatcgggcccgatcaggcggcagctttcctcgtgtgtcagcgttctcagcgattggtattctcgcactgctggttggcaaggccgcaggaggtcttgcaggcagactggcaggaggtctggcattcgccgcagccgccggtcttcaggctcttggccaggtcccgggtctccagggtctggattctcttcataagaaaccgctcctttcctcccccgtttcggggggttacgtcataaatcagggttattataatgtactttcccagggatgtcaatgggtacccctttgatttccctggccggcttgtgagaaccatttggacatgctataatgataattaccttatctttcttaaaatagaacggagaggagacaatggtcatgaaggaagagtgcctgctctgcggcgcgccgctggaatatcttacccgcggcagaaaaatggaatgcgcgctctgccacaaaaaagagcggagcaaaacccgctgtattaaagggcatttcatttgcaaccagtgccataccaaagggattgaccaggtcctcaccctttgcctggaaaccacctccgcaaacccggttgagattttggaccatctgatggcccagcccttttgtcatatgcacggcccagagcaccacatcctggttggcgccagcctgctcaccgcctaccgaaacgctggcggtgagatcgacttggcgccggcgctggtagagcttcagcgccgcgggcagcacgtccccggcggcgtctgcggtttctggggggcctgcggtgctggaatcagcacaggaatgtctctctccattctctcaaacgccaccccgctcagcaaagagcccctcggcctttccaaccagatgaccgctcgtgccctggatgccattggaaccatcggaggacctcgatgctgcaaacgaaattcctacctatcgcttctggctgcagcggcatttgtcgaagaacggtttcacctctctatgcccgtgcccgcaatccggtgcgcctacgctgggcagaacaatcaatgcctgggcaaagtctgcccgttttcgcctggttcctaacgggtaaccgcattctattcagcccaagaggaggggtactttatgccagcaaaacgcattctttttggctttcttctctgcctggccctatggctggtggtcctggcggcacaggcactgacccttggtacagagaaaagcctgtttccctatcgcacagagcaagtggcgtgcgtcgaattccaaaacgggaccactggcgcccggcatctggacaaggcacagcgggtcatccaggatgtgatggatcaccttcaccggttctctccggatgccgcagtgcccaaccagtgggaaggatggacctacggaattaccctccatttgaaggatgggcaaacctgtatgctgacactgcaccccgccgcccaggcggaggggtacggcgctgcggtggacctcaatggcacccgctatttttcccgggagaccgcctttcccctgacctggctggaggaatccttctccagcgtcatggccccctcccgttagcccgcagtgggcctcatctgggggatgctatcctggcagtgcaggcaaactccgtcaaaggtaaactccgccacaaaggccagcctcccccggcggtcccactccacaaagtctgtggggcgcacctgcaaggggttctttcgaaaatagtgcagccccgccaggcgcagcatggcgtagacaaactgcgagcagaacataatattgggctggcaggacatgggaaagagaaggcccagcagattataggcgctgccctcctggttgattttccgcagccgcttgagcatgatctgtttttgatggcgggtggccgccaggcggtacacccgcaccgaggcccccttccgctcggccagccccttgagggtctccgggttcaggccgggggcctccccgccctcgccgccgttgtagctcaccaatgttttcagcgcccggtcaaaggccagggagatgtggttgtaggcccggccggtaaacagcccgattacctctccggcgggactgttggagtgggtcagcgccaggtaaatatagccgtcggacagcgccgccgtagcctgggcaaaataggccgaagacaggctgccccggttgcagtaccggaagcagttgtgccgggtcaggtcccgccccaaatcgtatacgcagccctggctcaccacctgccaggcccgctgggcccgggtccggcgcccggacagccgggcctttccgtagactccccacaccacacacagcagcgccagagacaccaagggcccaaagggccggagataccagggggtctcaggcgcttgttttctctcgctcatgtccgtttccattcctttcttgcttgggttttttgtattgttgacctcatacaggcatacaaaaatcatacaggaaccggaccaattcgtcaacccttttcccccgtttctccactcgaccattgggaaagtccttggcgcgcaagggatttccttccaggacaaaaatgggccgcccggtgctctccgggcggcccactggtttttatcgtaagtttttccccaattcataggcctgttggggataatcggtgcgctccatggccgccaagtccccacaggagagggcggaaatcacccccacccgctcccagcccaggtaattggtcatgccctggaaggagaggaccgcgccggcggcggactccatggtgtcgtcctccatggtcagcagcaggacagcctttttgggggtacgcagggccgtgctgttggcgtagaaccggtcgatggccagcttcagctgggcgctccagtcatagtaataaatcggagaggcaaaggccaccaggtcggcctccagcagatgggggttgagttcctccataccgtccttgtagatgcagcccttgtcggtgttgtgacatcgctcacaggcccggcagggatggagctcctggaaggccgcgtcaaagcggaacaccgtatggccagcctcctgggccccctggataaacgcatccgccagcagggccgaggtgccgtgccggtgggggcttcctgttatcatgacaatcttcatttgtattcctccttactctgtttcactccttgggctgccatcagggacgtgctcctccccccgggccgcccgccgccgggcccgcaccagggccacccagaacaggacccccgccagggccagggcgccgcccagggccgtgcagatcaccgctgcggcctccgccggcacccagccggaccgccacagccacaggctcccgcccacggacccggccagcaccagccaggactttcccgccagcgcctgccaaatgggccgccgggcaggctgggcgcttcctcgaatccgccgggtctccttccaggtgaccgccaggaagggcccgtccagtccctggaagagcaagaaggtcagcaggggccggacccaccccacccggggcagcgtcccgtaggcccgaagtcccagccagaccaccgccgccccggccagcatccacaggcagccgtccagaatcagcagggcctgccggcccagaagaaaccggctccccgccgggaacgccctcccttggctcacccgtcctggtcccccagggcaaaggtggtgaagggcggcttaccccgggtgccgatcaggcggacccccgcccggtagagtccctccaccgtctccaccaggggaggggtaatttcctccccgggggcgatgaggggaatccccgggggataggcccagatgtactccccgcacaccttccccatggcgtcgtagaggaagctcagtccccccggggcttgggcggcctcctccaaggaacaccggcgggggggcagcgcaccgggcaccgccaaaacggaaggggtctcctcgctggaggcacaggtttcgtcaatggccagcagggcctgggccaggcgggccggcatggcgtcgtcggtgcccaagccggtcatggccaggacatagtggtccagggccatctccacctcgatccggtattcccggcgcagaaggtcccgcagcgccaccccggtcagaccggtcccctgggtggagatcagaatcttggccgggtccagggcgaagatgccgggatagtgcgcccccgcctcccggccatggcccagcacccgcaggtgccgcaggccctggatgccctggtcaaattccgtcagccgccggtgccaggcggcaaacagggcctctcccttctcctccagcagccggacacacccgtccatggaggccatgagcagataggagggactgctggactgaaaaattcccgtctgacgggccacctgaggcaggggaaccagcttgccgccggcgtggagaagggcggtctgggtcaggctggggagcattttgtgcagactggccaccgccaagtccgccccctgggccatggcgccggggggaaaggccgggtggaaccccaggtgggccccgtgggcctcgtccaccagaaccggaacccccttggcatgggccgtcgcgcagatccccgccgtgtcgctgaccaccccgtcataggtggggctgggatagaccaccagcttcacccccgggtggtcctccagcgcctgggccacctgctccggggagagggagccggccaggccgaaggtctcctccaccgggggcagcaggaacaccgggtccaggccgcaaagctcaatggcgtggtagacagccttgtggcagtggcgggccaccagaacctggtccccccggcgggtggccgcccggatggccgccagcagcccgcctgtgctgccgttgacctggaaatagctcttccggctcccccagagcttggccgcccggtccatcccctgggccagcacgccggaggggtcgtggaggtcgtcaaactccggcagttccgtgatgtccagctcggcccccagccgggccaggtagggggccagcgcggcgttctccttgtgccccggcatgtggagggagaggtaccccgccttatgatgggcctccaggcgctcccacagagcgcgtcctgcttcttctgccataaaaaggcctcctttgcaaaggaatggatcaaaataatataaggtatgataccagaaagcaggccagatgacaaccggcaagggagatctggcctgggccctttcctggtaccgccgcacctggccttataaaaaacttctattttggggatttgaaccaggccaggtccatggtatcctgggaccacgtcagaaaaccagcccagaaaaggaggcccttccccatgaccacaaaaaccgccgcccagcgcggcaccgccgtctctgtgaaatcccttgccatcaccgccatctgcctggtgctggtctatgtgttcaccgccgtggtgaacattcgcttacccttcgcccccaatggcgggctcatccatctggggaacgtccccctcttcgtggccgccattctctttggcaagcgcaccggcatgatcgccgggggcatcggcatggcgctgtttgatctgctctccggctggaccctgtgggcccccttcaccctggtgattgtcggctgcatgggctttgtggtgggggcggtcaccgagaagaaaaagtccttccccttctatctgctggccctgctgctggcctgcgccatcaagatcggcggatactacctggccgaggccgtgatctatcaaaactgggtggtgcccctcacctccatcccgggcaatttgattcaggtgggggccgccgccatcatcaccctggtggtcattgagcccctccgcctggccgcctgccacaccatcttgcggaaataattgcagcctttcccccattctgtacctcaaatgcaaagacgccgatgcaatttcggcgtctttttgcaatttcctttccttggactttcatcccgaaccagggttgagaaatttgtgggatgccgcaaattttatcggaaatttttcaaaataattgttgcatttagaggagtgacgtgctatactttcatttgcaaatgggaagttttgaggtgattcttccaaattgcaagtatccttgtattttcgcctggagtcgccaggtaaaaataaattatcaacgaaggagccaaaacatcatgaatgcttatatcgaaagcgttattgaaaccgttaagaaaaagcacggcagtgagcccgagttcgtgcagaccgttgaagaagtcctgagctctctggaccccgttgtctccgcacaccccgagtacgaggctgttgacctgctgggccgtatggttgagcccgagcgtatgttcaccttccgtgttgtgtggaccgacgacgccggcaagacccacaccaacatcggctatcgctgccagttcaatggtgctcttggcccctataagggcggcctgcgcttccagcccaacgtgtatcccggcatcatcaagttcctgggcttcgagcagatcttcaagaactccctgaccggtctgcccatcggcggcggcaagggcggcgctgacttcgatcccgccggcaagtccgacgcagagatcatgcgtttctgccagagcttcatgaccgctctgtatcgttacatcgggcccgacgttgacgttcccgccggcgacatgggcgtgggcggccgtgagatcggctacctgtatggccagtatcgccgcctgaagggcaccttcgagaacggcgttctgaccggcaagggcctgtcctatggcggctccctggcccgtcccgaggccaccggcttcggcgctgtctactatctggtggaagtgctcaagcacgagggcgaggacatcaagggcaagaccattgccgctgctggcttcggcaacgtgacctggggcatctgcaagaaggccaaggagctgggcgccaaggtcatcaccctgtccggccccgacggctatgtctacgatcccgacggtgtgtccaccgacgagaaggtggagtacctgctggagatgcgtgcttccggccgcaacgtggtaaaagattatgctgacaagttcggcgtgcagttcttccccggcgagaagccctggggtgtcaaggctgacatcatcatgccctccgccatgcagaacgacgtcaacatggagcaggccaagaagatcgctgagtgcggcgccaagtactacatcgaggtcgctaacatgcccaccaccaacgacgctctggctttcctgatgggccagaagcacctgatcgttgctccttccaaggctgttaacgccggcggcgttggcgtttccgctatggagatgtcccagaactccgagcgtctgtcctggaccgttgaggaagtcgatggccagctgaagaagatgatggagaccatccacagagtctctgctgaggctgctgaggagtatggcctgggctacaacctggttgccggtgctaacatcgctggcttcaagaaggttgctgaggctatgatggagcagggcatcttctaatttcaccccgctatgttctctcgaaagggacccgccctctggacgggtcccttttttccgctccagcccatcgggaaaggaacccattatggcataccaaaacgatgaccttcttgctttccggcagctgcgggcccaagcggcccggaaaaagcagctggagacccagcgggctgccctgacagaccggtgccaggtcctctccgtccaggcggaagcctgccggaaggccaggcaagccgcggaacaggaggtggccaccctggaatccaaggggcccatgggccttctctacaccatcgccggggacaaagcaaaacggctggatgaagcccggcagacccttcgaaaggcccgggccgacgaccaacaggcatcctgggacctggcccaggcccaggtcgatctggcccagactgagcgttccctggaaccgctggccggctgtgacagcgcctttgccgccgcccggcaggcccgggccacaaccctccaagccgctgacctgccccaaagccgccagctacgtatcctggaagaggcccttgcccagggggaagattggttccaacgtctcaccgatctgtgcgcccagtgccgtgccgtcctggacgcggcccggcaaaccctccgtctggccgagcgcgtggaacagtttcgcaccccctccacccttgcccttctgcaggacgcggccgatctgaccgtgcagcagcagcagaaattggaccaaaatctcaccgccctcctgacggggatggaggagagacagacccaactggagcagacactggacgacctgctggcccaggatttgttcccctcccctgtggaagaagcgtttcctgactgaccaatgaaaccgccagcggcgcaaggccgctggcggtttggtttctgttatccttccacagtgttttccaaaacaccaatgccctcaatctcacagcggaccacatcccccgcccgcaggaaccggggcggatcaaagcccatccccaccccagccggggtcccggtggcgatgatggtgcctgcctgtagggtcatcccctgggagagctcccggagaatgtgggggatggaaaaaatcagctgatcggtgaccgcctcctggcgcagctgtccattgacccaggtgcggatggcctgggccgggggctggggaaaggcctccttcgtcacgatacagggtcccatgggcgtaaagccgtccaggcccttgccgaaataccactgcttatggccggtctggagattccgggccgacacgtcgttgacaatggtatagccgaacacatagtcaaaggcctctgcctccgtgacgttttttgcatcccttcccaagatcaccgccagctccgtctcataatccaagctgtccaccaggtcaaagtggccggggatgggggcgccggggccggggcagtgggtggcccgtttggaaaagtagaccgcctgggccttttcccgggtgaaggccgcggcgtcaaaccgctcggcctccgtcttgtgcttctgatagttcatccccaggcagatcacatcctgccggggatggggaatgggggcgagcacctggacctccgccagggcaaactcgcccgagcccttgcccgccttctccagcacccccgcccggtggtccggccggtctgccagcaggtggttcatggtctcatagggcagcggcgtcagccggcccgggcggttctccagacagaccagcgggcggttctgccaggcaatggtgtatagtttcatcggcatctgcctcctttttctttcgtggggcggttatgtctcttcccatcggtccagcgcccggatcagcgcctggaccgcctggggttccgtggcccagctggtgcagacccgcaccgccgtgtggccaccgtccaccttgctccaaaccgtaagggcaaattcctcctccagttgggccaaaagcccatcgggcaaaatgggatactgctgattggtgtaggagtcaaagagcatctcatagccccgggtctcaaaggcccggcgcagctccatggccagccggtcggcatggcgggccagttcaaagtaaagtccgtcctccagaatggcacagaactgcacccccagcagccgacccttggccagcaggccgccgtgctgcttgatgtggtaccggaaatcccgccggagggcggggtggctcaaaaccagcgcctccccaaagagaaggccctgcttggtgcccccaatggaaaacccatcgcaccggcgggccaggtcgggcagggtcatgtcacaggcctcactcataaggccgtaccccagccgggccccatccacaaagaggaagaggccgcagtcctggcaggtctcccacaggtccgtcagctccgccaggctgtacagcgtcccattctccgtgggctgggagagatagaccatccccggctgcaccatgtgctcccgagtggcatcctgccagtggctctcatagacccggcggacctcccgtcctgtgagcttgccgtcggcgctgggcaccgccagcaccttgtgcccggtggcctcgatggccccggtttcgtggacattaatgtgcccgctggtggccgcgatcaccccctgatggggccgcagcgcggcggcgatcacagtggtgttggtctgggtcccccccaccaggaagtgaacgtcaatcccctcccgctggcacagctgctgaatatattcccgggcccgggcacagtagaggtcctccccatagccaggggtctgctccaagttggtctcaaacagccgccgcaggacccgctcgtgggcgccctcggcgtaatcacattccaatcgaatcataccaatccctcctgtccccatggaagcggcgggcaaactcccccgcttttcggaccatgtttcctggcgttttgctccattatacgtgcttgccggccaaaggtcaaccgacagccctggggaattcccctcttattttgtcggaattcccccagtccgcctctcttttgttggttttccaacatacacttccttccgcctccgctatactatgggtaccatattcgggccccagggcgccgtacctcgccgctggcccgaggcaaggaggtttttcatggaatccaacatgttttgctatcaatgtcaggagaccgccggctgcacccgggtgggggtctgcggaaaacagccggaggtggccgccctgcaggacctgctggtctacgtcaccaaagggatgtccgccgtgaccacccagctgcgggcggagggtaccccggtggacccggagaccaaccactgggtcaccctgaacttatttcttaccatcaccaacgccaactttgacggccccgccctccgcgcccgtgtgcaggataccctggaccggaaggccgtcctgcttgcccaggtccaggacccctcctgccttcccgaggcagctcactggaccgggcctcaggctgtctttgccgacaaggccgccagggtaggggttctgtccacccaggatgaggacgtccgcagcctgcgggagttgatcacctacggcctgaaaggactggccgcctacaccaagcacgccaacgccctggggcaggaggaccctgatctggacgccttcctccagcgggcgctggccgccaccctggaccaccggctcacccaggaggagctggtagccctggccctggagacaggacagtacggcgtgaccggcatggcgctgctggaccgggccaacaccaccgcctacggccacccggagatcaccaaagtgtccctgggggtgggaacccgccccggcattctggtctccggccatgacctgcgggacctggagatgctcctggaacagacccagggcaccggggtggacgtctacacccattcagaaatgctcccggcccacgcctatcccgcttttcgcaaataccccaacttcatcggcaactacggcaacgcctggtggcagcaaaaggaggaattcgaggccttccagggccccatccttatgaccaccaactgcattgtcccccccaaggacagctacaaggaccgcctgtacaccaccggggccgccggctggccggggtgccggcacatccccggggacattggccaggagaaagacttctcccccctcatcgcccaggccaaaacctgcccgccccccaaggccctggagcagggagaactggtgacaggctttgcccaccatcaggtgctggccctggccgatcaaattgtggcagcggtccagaggggcgccattcggaaatttgtggtcatggccggctgtgacggccgggccaagcgccggagctactacaccgacttcgccaaggccctgccccaggacaccgtcattctcaccgccggctgcgccaagtacaaatacaacaagctggacctgggcgacattggcggcattcctcgggttttggacgccggccagtgcaatgattcctactccctggccctcatcgccctgaagctgaaggaggtcttcggtctggcggacctcaacgacctgcccattgtctacaacatcgcttggtatgagcagaaggcggtcattgtgctcctggccctgctctccctgggggtgaagaacatccacctgggccccacccttcccgctttcctcagcccccgcgtggcccagctgctggtggacacctttggtatcgccggcatcggcaccgtggaggaggacctggcccgcttctttggggcgtaacgcgccttttgacacaaagaatcctgaacccagttgggttcaggattctttgtcttttctcacggctcaggcagaaccgttcgctttaggctggtgtaagccatcaggatatagatgccgtagaggaggaaaaacagacccagcgcggcggctgtgatcatcccgggggaatagagccccgtgagggtccccggttccaccgcaccccccaggtttcggacaaaggccaccccaatgatccctgccggcaggacaggcatggcatagtatagggcaaactgccgcctcagcgcccgccccatctccgttccatccatgcccagttttcgcagcagttcaaactgccgacggtaacggtcggtctcgctgagctgctgtacggtgagaatggtggccgcagtcatggccaaaaccaacgccagatagtacaggggaaagaccgtcatagcggacagggcggcaaactcctcccgctgatccgccctgctgtaaagggtgtcgtagtccttccccgcttcctcgtaaccgtcacggatggtacataacgcggcaaactgctccgccgtcaccggctgttccgtcatggcagccagaacactgtggctcaccggccgcgccgccgccagccggtccgggaccacgatcacaaagccgtggccgttggcatcccacaggtcctggttcaattccccggtctggacctccgccggggtcaggcgctgtccggccacggagatgggctgatgatagtccgtcaatgcctgggccaggtagtcccggcagtggaacagacacgtccccggcgccagggtcaccgccggccagcccttcatggcccgcagagcgttgtaatccgacagccccagcaaggtatcctcgtcataatactggtgatagtccgccttctccaggcaatacgtggtgacctgggcgttctccccctgataaatcgagtactgccgggcactggtcacagggaccgcccggttcaggtacgcctgatacgccgccaggtgggcctgatccttagtgccaatgtacaggtcaaaggcagagaccttttccatccgattctggaacagggcgctgaagaccatgccgctcccttctgaaaggagggtagcggtaaagagcagggagatggtggccatcaccacccccatggtggccagcttggcggtgagggtgcggaaaatcaccagggtctggccccggtacttccttccgggatgtttttcaaaaaacgcgggcacccccgaggcaaagctgagaaagaagccatagagaaaggcgatgatacaccccgcccccaccaggccaaacagcagccc

SEQ ID NO: 2248 - DNA, 14790 bp, KLE1738
cgcctgctggacctgcccgctgacggcgtggcgggagtgcccaaggtggagctgctgggagaccgggagctatatctggaaaactacaaggggattctctcctatgggaaagaggagctccatgtggatggcggggcctgggtgctgcggatctcggggcgggacctggagatcaaggccatgcgggagcgggagctgcggatctttggctgggtcagcaagctggagattctgtgaggaaggggagaggggtcggctgtgaaaacgttgttggcctggctgttcggcacggtgaccgcccggatcaccggcgcccagccggaggattttttgaatctctgcgccagagagaacctggtgctgtggaggatggttcagcgggacctgttcaccctggaggtccaggtcaccgcccggcagtacgcccggctgtgccagctggcccagggagcccagtgcggggtggagctggagaagcggcagggactgccctatttttttctgcggttccgccggcggtatgccctgctggcgggggtggccctgtgtctggtcctcttcgccatcgggtcccggaccgttctgaccattgatgtcacaggcaacgagaccgtcaccagggaggagatcatcagccagctgcgcctgtgcggggtgtccgtgggcacctatggccccggcatccccatccgggaggtggagaacaggatgatgatggccatggacgccctgtcctatttctccctaaacctccacggcacccgggcggaggtcattgtccgggagggggaccctgcgccggaaatccgggcggagacggtacccaccgatgtggtctcctctgccacgggggtgattacccacatcgaaccctgggtgggggatgcccagtttcaggagggggaggcggtgtgcgagggggatgtcctcatctccggccgcatggaaatggacaccgtcacccccaccgagcacgatctggggaccatgctggtccacgcggaggggaaggttttggcccagacctggcacaccctcaccgcccagatctccctgaaggcccaggtaaaaacctataccggggaggaaatccgccattacagcctgtccctcatgggcaagcgggtgaaattttatcaaaacagtggaattccctatgagaattatgatacaatatcggaacaaagggcctggaccccgatccagggaaagcagctgcccgtggtgtgggaaaaggagacccaccgggcctatgagaccagggagatcaccctggaccccgcccaggcggaggagatgctccgccaagcgctcatggaggccctggaggagcagatggaggaggggaaggtcctgcaggcggactatgaagtgacccgccagggggacctgctccaggtgaagctggtggcccagtgcaccgagcagatcggccggatggtggagatggacacccaggagaaggcggtggggccccggcacccagagaagggaaccaccggggccgacgagaaaaccaaggaagcggaacgcgcggaggagtaattgcccatgatggaacagacagtcagcattgaacggatggaggacgccattgatatcttcggctccttcgatgagaacatccgcctcatcgagcaggagctgggggtccgggtggtgggccgggacgaccagctgaaaatcagcggagaggatacgccggtggcctatgccgccaaggtgatccaagggctcatcggcctgtcggcccggggggagagcatccatgagcagaatgtccgttacctcatccagctggtgaagtcgggcaacgaggacaaaatccagaccctggccgccgacgtcctctgcgtgaccgccaagggaaagcctgtgaaggccaagacggtggggcagaaaaaatacgtggatgccatccgggccaacaccgtcaccctgggcgttggtccggcgggcaccggaaagacctatttggcggtggccgccgcggtggcggcctttcgggccaaggaggtcaaccggatcatcctcacccgcccggcggtggaggctggagagcggctgggctttttgcccggggatctccagagcaaggtggacccctacctgcgccccctgtacgacgccctgtttgagatgctgggggcggagagctatgccaagtacgtggagcgggggaacattgaggtggcgcccctggcctacatgcgggggcgaaccctggacgattccttcatcattctggacgaggcccagaacacctcccgggagcagatgaagatgtttctcacccggctgggttttgggtccaaaatcgtcatcacaggggatgtgacccagattgacctgccgggggacaaggtctccggcctgaaggaagccatgcgggtgctgcgggacgtggagggcatcgccctgtgccgcctcaccgacagcgatgtggtccgccatgtcattgtccagcggatcatcaaggcctatgaagaggacgaaaacagaagaaaggcgaaacgctgagatgaacaatcacgatatctatattgactgggagctttccggccccaacccttaccgccccctgctcacccgggtgatcaccgccgccctggcggcggagggggtgcaggtcccctgtggggtggatgtgctgctgaccacggacgagggcattcgggagatcaaccgggagcagcgggccatcgacgcggccacggacgtgctctccttccccatgctggagctcacccccggcgtcccccccgacggcacgggggaggaccagcgggacccggagaccggcctgtgtcccctgggggacatggtgatctccgtggagcgggcccaggcccaggcggcggagttcggccacagtgtccagcgggagatggcctatctggcggtccactcggtgctccatctgctgggctatgaccacctggacgagggcccccagaaggcccagatgcgggcccgggaggaggccattttggagggtctgggggtcacccgggaccactggaacgaggacctggacgcccccctggcgggcccagggacagaggaggtgccggtgaagcgctgcgggatgattaccctctgcggccggcccaacgtgggcaagtccaccctcaccaacgccctggtgggggagaaggtggccattgtcagcagcaaaccccagaccacccggaaccggatctgcggggtgctcacccggggggagaaccagtttgtctttctggacacccccggcctgcatcgggcggccaaccgcctgggggactacatggtggacgtggtgagaaagagcgtggccgacgtggacgccgtgctgctgctggtggagcccatccccaacgtggggggggccgagcgggagctcattgaccggatcaaggggatgaaggtccccgcggtgctggtcatcaacaagattgacacggtggagaaggcccagctgctggcggtgatggaggcgtacagcaaggtccacgacttcaccgccattgtccccatctccgccaagcggcgggagggcctggaggagctgctggacctgctggccaccttcctgccggaggggccccagctctttccacgggacgcggtcacagaccagcctgagcggcagatctgcggggagattgtccgggaaaagctgctgtactgcctggacaaagagatcccccacggcacggcggtggaggtcaccaagttctccgagcgggacaacgggatcattgacctgcatgtgaccatttactgcgagaaggcctcccacaaggggatcatcattggcaaacagggggccatgctcaaaaagatctccaccatggctcgggaagatgtggagcggtttatggggaccaaagtctatctggagacctgggtgaaggtgaaggagaattggcgggacaatttgaatctcattcgcagcttcgggtttgacaaccgggagtgaggcggatggggcggccttgtgggtttggctccacgccgttggaacggcggggaaccttggcctgcccggccggggccccatttcttgggaagaaatgggggaaagaaccccagagggaagaggttcttccctctggactcccttctctggtggggttgtgtggggggaagttgtacttctcgctggttacctggcctgcggccctcacattggaaggcccgtaacggcccgcccaccggctgggcgggctgggggcgtgggaaggtgccctttgggagaaagtagagagtaaccgtttggtttcccactttttcctcctgtcaacaaaccacttctcccgcccgcccgagccggtgggcgggccatgaggcgctggttttggaggccgcaggccaggtccgcatctaaccaactaccttcccccgtttctcgcaccagagaatagggttccaaggggaaggaacctccttccccttggtgttctttcccctatttcttcaaagaaatagggccccgcccgggagggccaagttcccgccgttccaacggcgcaggagaaagatgacaacgcccccagccaggcgcctgcctggaaaaaccgaaatttaccgatgataaaacagccctccccctgccaagctaaccaaagaacgccaagacaggaggagatggccatgacatccaaagaattgtgggccctgtttttgcagacgggcctgcctgagatctactgcctggcccggcgtcgggcgcggcaggaggcgaaacaagcggcggagagagggagagaccatgcgcctgaccacccagggaatcgtcctgcgggagaccaactataaagaggcggacaagattctcaccgtcctcacccgggactggggcaagcgcacggtgaaggcccggggctgccggcggaagaacagcaagcttaccgcggccagccagctgctggtgtactctgagctcaccctgtccgagcggggggagtttaccaccctcaccgaggccgaccccctggaacagttctggtcggtgcgccaggacctggagaccctggccctggcctcctattttgccgaggtggcggaggcctccgcccaggagggagagacctgcccggagctgctctccctgctgctcaactgcctctacgcgttggacaccttgaaaaagccccgggccttggtgaaggcggtctttgagctccggctgctctgcctcaccggatatgagccgctgctggacgcctgcgcggtctgtggcgcgccggagcccctccgggcccggctgcacctctcccagggggtgctctgctgcgccgcctgccgggggcggctggggggcggggtgtccatgcccctgtccccgggggccctggcggcggcccggtacattgtctcgggcccgcccaagaagctcttctcctttgccctggcggaggagagcctccggcggctggggcaggccacggaggcctttctgatgacccagcaggagcgggggttccgcacattggattactataagcagctggagcgaagcctgccggaggcgggccgcggataaggaggagaaactgtgccgctgcgctttgtaccgattaccgaggaaaaccggagagaggtggagaacctccaactcttcccggaacagcgttcctatattgaaagtgtcccggaatgcctggccgaggcagagcagacccgggaatggagaaccgtgggcatctacgatgggccaacggtggtggggtttgccatgtatggatgctttgcccagccggaaccggaggggcagctgtggctggaccggctgctgatcgatcgggcctatcaggggcggggctatggtgcgggggcggtggccgccctgctggagcgcctgcccaaggagtatggaaaggaccgggtttttctgagcgtatacgacgacaaccagggggcgatccgtctgtatgagaagcttgggtttgccttcaacggggaacttgacaccaagggggagcgggtgatggtctacaccgtgccccgcccagacgccccaaccgagagagaagagagggagcgagcccatgacagatctgtttgaaaaatccatggaaaccctggagctgccccgggtgctcagcctgctggctgaccaggcggtcacggaggagggcaaggagcgggcccgccggctgcggccggaaaccgacccggcggaggtggccctgcgtctgaaagagaccacggcggcagtaaataaaatggtgctgcggggcagtccctctttttccggggtcaagccggtggccggctccctccagcgggcggacatggggggaagcctgaacacccgggagctgctggacatcgccggggtgctggccgccgcccggtcggccaaggagtacggggagagcgacggggaggagaaaagccccattgacgtcctcttccattccctgcaccccaaccggtttttggaggacaagatcaccggctccattgtaggggacggggagctggcggactcggccagcccggagctggcctccatccgccggcatatccgggccacggagagtaaggtccgggatattttgcagaagatcatctcctcctcccaggccaagtacctccaggagagcatcatcacccagcggtccggccggtatgtggtgccggtgaagtcggagtttaagaacgagatccccggcctggtccacgacctgtccgggtcgggctctacctttttcatcgagcccatgggggtggtgaaggccaacaacgagctccgggagctccaggccaaggaggagaaggagatcgatcgcattctggcggagctgtcggcggaggctgcctccttccgggaggacatcaccctgaactatgacctgctcatccgcctggacagcatctttgcccggggcaagctctccgcgcggatgggggccatggagccggggctgtccgccaaaagtctctgcctgcgccgggcccggcaccccctgctgccccccaagacggcggtggccaatgatctgtccctgggggagaagtttgacacgctggtcatcaccggccccaacaccggcggcaagacggtgactctgaagaccatcggtctgctcaccctcatggcccagtgcggcctgcacatccccgccggggacgggagcaccatccgggtctgccagcgggtgctggcggacattggggatgagcagtccattgcccagtccctgtccaccttctcctcccacatgagcaacatcgtgggtatgctggccgagaccgacggagagaccctggtgctttttgacgagctggggggcggcaccgacccggtggagggggcggccctggccgcggccatcattgagcacgcccggagcctgggggccttggtggcggccaccacccactatgctgagctgaaggtgtacgccatgaccaccccgggggtggagaatgcctcctgtgagtttgatgtggagaccctggcccccacctaccggctgctggtgggcattcccggcaagtccaacgcctttgccatctcccagcgtctgggcctgccccaggagatcatccagcaggccgccgcccgggtgagcgccgagaacgtccgctttgaggatgtgctcaccaagctggaccagcagcgccaggagatggagaaggagcagcgccaggccgcccagctccggctggagatggagcaggccgctgccaaggcccaggaataccgggacagcctgcaaaaggaaaaggagaaaaacgaggcccgggccaaggcggaggcccgcgccatcctggacgaggcccggcgcaccgccgacgaagtcttccgggagctgggagacatgcggaaaaaggcccagaaggaacaggattggcaggcggtcaacgaccagcgggccggcctgcgccaccggctcaacgaggcggaggacaaattgggcgttcgggagaaagcggcgcccccgcccatgctccgccccgcccagaagggggacacggtgaccatcctgaaaacaggcacccagggcaccgtcctgtcggtgaacaaggacggggtgctccagctccaggcgggcatcctgcggatcaccgccaagcaggaggaggtccgggtggtggagggggagacccagacacaaaaggccgcccgccagtacatccagcgcaccgagcacaagctgcgcagcctgggcgccaaggccgaggtggacctgcggggcatgaccaccgacgaggcggagatgaccctcagccagttcctggaccgggccatcatgggcaacctcacccaggtcaccgtcatccacggcaagggaaccggggcggtgcggaaggccgtgcacacctatctgaaacggtgcaaaggggtggcctccttccgcctgggccggtacggcgagggggaggacggcgtcaccattgtggcgctcaagtgagattcccggcctgccggggagaatcccggcgctccagggaaaactataagggaaaaagacaaaaaaagcgtgtaaattccgtggaatgccatgaaaattggcattgacggacacccggaaatttgctattcttatggtagcattttagggaaagaattcgggagggactattatgtatatcaagcaggcaactgtcaataatcaggtcggccttcatgcgagacctgctaccttctttattcagaaggcaaacgaattcaagagcaccatttgggtggagaaggacgagcagagagtcaacgccaaaagtctgctcggtgtcctctccctgggcatcatcaagggcagcaccatcgacctcattgccgacggcaccgatgagaaggacgccgtggacgccctggtggagctcattagctctgacttcgctgactgagctgacacagtaaggcaaaaaagcgccgcgtccgcggcgctttttttactcccatggatcggagagaggagggagcggatgacctttgaccaactgaaagagaaggcgctgagcctgcccctcaagcccggggtctatctgatgatggaccgggagggcactgtgatctatgtgggaaaggccaaggccctgaagaaccgggtgagtcaatacttccacgaccaggcggcccacacggagaagacccgggccatggtggcccagatcgaccactttgacaccattgtggccgggtcggagtttgaggccctggtgctggagaattccctcatcaagcggcacaagccccggtataatattttgctgaaggatgacaaaggctatccctatatccggctgtcggtgaaggaggcctatccccgtttctccatccaggggcggatggccgacgacggcgcccggtattttgggccctttggaggacgccacgacacccagtccattctggacgccctgcggaccgccctgaagcttccggcctgcgggaaggtgtttccccgggaccagggaaaggagcgaccctgcctcaactaccacatgggccagtgtgacggctactgccggaaggaggtcccgcgaagccagcaccagcaggccatcgaacaggcggtgcggctgctggagggaaagtttggcgaggtggagaaggagctgaagggccagatggaggaagcggcggaggccctggagtttgagaaggccgccgccctccgggaccgtctccgggccatcaccctgctgggcaagcgccagaaggtggtggcgggctacctggccgacaccgatgtgctgggcctctacatgggggaggtccgcagcggggtggcggtgctccacttccaggagggggagctcaccgggcgggacctggaggtctttcccacggcgggggagccggcggaggaaatcttgtccgcctttctggtccagtattacactccccggggcctgctgccccggcagattctcctgccggaggccatggagggagcggcggacctggggcggctgctctcccaccaggccgggcggaaggtggagctggtgaccccccagcggggggccaaggccgacctgatccgcatggcccaggagaatgcccggaccgagtgcgagcgcctgaccacccgggaggagcggacagccaaaatcctcaccctcctggcccagctgctggagctgcccgggcctccccggcggattgaggcctatgacatctccaacaccggggcggcagacattgtggcggccatgacggtttttgagcaggggcggccccgaaagggggcctaccggtactttgccctgcgggacctggacgggccggacgactatgcctccatggaccaggtcatcacccgccgcttccgccatgagaaggagggggatgagacctttgccagccgcccggacctgctgctcatcgacgggggagaggcccatgcggcggtggcccttcaggcactgacccggtacggcctggacatccccgtcttcggcatggtcaaggacgaccggcaccggacccgggccctggtaacccccgacgggcgggagatcgggattcaggcggtgccggcgctgtttgccttcattgggcagattcaggaggagacccaccggtctgcggtgggcttccaccacaaacgacataccaagagcggcctgggctccaccctggagcgcatccccggcatcggggaggcccggcggaaaaagctgctgaaggccttcggcagcgtgaaggccatccgtcaggcggacctgccggccctggaggaagttctccccaaggcggcggcccgggcggtctatgaacagttcagaaccaaagaggaggaaacgacatgcgcgtcatcacaggcacggcccggggccggcggctgaaggagcccgtggggctggagacccgtcccaccgcagaccgggtgaaggaggggattttctccagcattcaatttgaacttgagggccggcgggtgctggacctcttcggcggcacagggcagatggggattgaggccctgtcccggggcgcggcccatgccacctttgtggacctgcggaaggaggcggtggggatcatccgggagaacctgtccctgaccggcttttccgaccgggctacggtggtccagggggactatctggcctttctcacccgatgccgggagacctttgatgtgatctttctggacccgccctacggcagcgggatgctggaaaaggcgttggaaaccatcacaacgattgacattgtgtccgaaaatggtataatagtttgcgaaaatgggtcgactgtgggctggccggcggtacgggcaccctatcggctccaaaaagagtaccggtatgggaaaatccgaaccgccctgtaccggcgccaagccgattgaatcccggccccaaggcggaagacggaaaggacaacatgctatgaagaccgcaatctaccctggcagctttgacccggtcaccctgggacacatcaacatcatcaaacgggcggcggtggcctttgacaaggtcattgtctgtgtcatggtcaactcagagaagaatggcggcctgtttaccccggaggaacgaattgacctgatgcgaaagagcattcaggtgagcaacgtggagtttgacgtaaactacggtcttgtggcagagtatgccaaggcgaagggcgcccgggtcctggtcaagggcctgcgggcagtgtccgactttgagcaggaagtccagatggcgatgatcaacagcaagataaaccccgatctggacacggtcttctttccctccagcgaaaagtacacgtatctcagttcctcagtggccaaggaactggcccggtaccatgccaacctggacgagtttttgccccgggaaatcattgatgacgtcaaaaataaactggaaataaggagcgatgagtgcgatggcaggcagcgttgaggaattactggaccttttatatacggaaattgaggaggcgaaaaacgcccctctcaacaacgaccggtgcgtcattgaacgggaccgggtcctggacatgattgacgatgtgaaggcggaactgccggtggagatcaagcgggccaaggacctggtggccaaccggaacgactatatcgcctccgccaagcgggaggccgacagcctgcgccagcaggcggaggactacgccaagcggctggtgaacgaggacgccattgtgcgggaggcagagaagaaggcggatgagatcctttccgatgcggaggagcagtgccggatgctcaaggccgccgccagcgagtactgtgaggataccctgcgccgcatggaggaggccgtggccgacgcctacgacgaagtgaagcactcccgggccaagttccgttccgccctgagcgccgcctccggcgggcccgccccccggagccagccggcaccccgccgggccatgtatgacgccgaggccgatgaggacgaggattgagctgtgaaaagagaccacccatgggtggtctctttttttgcgcctggagggaatcagggctccggcgggagaaccccgctgtcgttaataaccagggtgtctccggcgaggagaacggtgtctcccttggggatgagcacgtctccgccccggcggaccaggatgatcagacgggtgcctgtggacagggtggacagggggcggtccagccaggggtctcctgtctccagggtgcgctcgtaaaggcggaccccctggatggccccgccggcccggccgctgaggatcagggtatcccccggctccagaacggtgctgccgtgggggacccactgctggccccggcggaggaggaggaccagcagacagtccgggggcagggagagggtgcgcagagcctgccccgcccaggggtgatccggtggcagggtacactggagaaactggacgggtacctcatcggtgtagtcggtgaaggttttcaagacgttggcctcctggtcggtcatgttcagctttttggccaccacggggataagggtgccctggaccaggatggaaaagaggacgatgaagaagacaatgtggtagaggtccagattggtgacggcgggactggtaatggccagaatggagaacacgatggaggccgccccccgcatccccgaccaggcgaccagggccatctgacgggggctgctgcggaagggggccatcagcagaaagaccaccgccggccgggccacaaaagtgaggaagaggaccacggccagggccgtgggggcgatggcgggcagctgggaggggaaagagagcagccccagcaggaagaacaggagcatttgcatgagccctgtggccccgtcaaagaagttgaccagggctttcttgttctccaactggctgttgcccaggaggatgccggtgatgtatacgctcaggtagccgttgccctccagcagggtggggacgacataggacagcagggccaccgccaccaggaaaatggcgtcgaacccctctgaggcaaaccgaaagcggcggagaaaggcccgggccgccagggcaacccccacccccagggcgccgccgtagaccagctgggcgaagatctgatagacaacggctggggcggaaatctcccctgtcatcagggtgagaagaatgagggtgagcatgtaggagaaggggtcgttgctgccgctctccacctccagcagggaggcggtgtggtcccgaaggttcagccgcttggagcggaggatggagaacaccgaggcggcgtcggtggaggcgatgaccgcgcccagcaggaagctctccaaagtgggaagggacagaaccgcccagcagaacagccccaccagccccgcggtgaaggcggtcccgaaggaggagaggatggcggccttccccgccacaggcttggcctggctccagttggtgccgaagccgccgtagaacatgatgaagatgagggcaaaggagcagatgttttgggccagaccgtagttgtcaaagggaatcttgaccaccccgtccgagccgaagaacatgcccagcagaatgaaggccagcaaggtgggcacccccaacttgctggagagcttgttgcacagcacgcaggccaggatgacaagggcggagagaagcagcagatgggtcataagcagtcctttcagtacagagcgtgggagggaaaaacataccatattactattttagtatctctatcataccaagataacgccgcgatgacaagcccggatcggggtccggtcaaaagggagaaaaaagagcgcctcccaaaaaacagttgctttttacaggcaacccctctataatgaaggaaccaatgccggcctaaaatggccgggttggggaaagaagacgagttctttcctgatcttatgaattcactgagggccctgccctctgaggagcttttgcatcaatgagtggagcatacacacaccggccggttctgctggaggaggccatccaggggctggccatccgcccggatggggtctatgtagacggcaccttgggccggggcgggcattcggaggcgattgtcaggggactgaccgccggcggtcgcctgctctgtatcgaccgggacagccaggccctggaggaggggcgggcccgcctggccccctgggccgggcagatcaccttcctccacggtaattttggggacctggcggccctgctggacggggccggggtggagcgggtggacgggatgctctttgacctgggggtgtcctccccccagctggatgacccggcccggggcttttcctatcaggcggacgcccccctggacatgcggatggatcagggggagaccctgaccgcctggacggtggtcaaccagtggccccggcaggagctgcggcggg

SEQ ID NO: 2249 - DNA, 14236 bp, KLE1738
cggcgccctggtggagatcatccggggcgccctgccggcagccgccctgcgggagaagcagcatccggccaaacggagttttcagggcatccggatcgcggtcaacgacgagttgaccgccatctcccggatgctccaggccgccattccccggctgaagaccgggggacggctggcggtgatctcctttcactccctggaggaccggattgtcaagagtgagctggccgccgcggccaagggatgcgactgtcccccctctttcccggtgtgcgtctgcggcaaacggcctctggtccggctggtgaaccggaagcccatcctgcccagccaggcagaacaggaggagaatccccgggcccggagcgccaaactgcgcgtggcggagaagctggaagggtaaacccgaggaaatcgaccagatgaggtggagcaaatcgtgacaggcaaacaaacccagggcgccgtggcctacgacggcaccggagccctgaaaatggccgcgccggaggcgccggcccaaaagaagaagtttcggaaaaaggaaaccaaagggaaaaaggagaccaaggaaacgcagcatcccgtggttaaaaacggtgccgccctcttgaccaagggggcccggtggaccgttccgggggcgatcctggccattctgacggtggccctggtggtggttatcacgttggccagctatgcccagttggtggtggtcaatgacaaggtggtggagctccgcaatgaactcagcgagctccagtcggaggagacgcagctgaaggcccagtatgagctggcctatgacctgcaggagattgagaggcagatgcttgccagcggagagatgatgaaagtccagagctggcagacctatacgctggagctctcggagcccgacacggtggagtatcaccagggctcggaccttgcccagcagatcatgtcctttgcaaagaaccttgtctccgcggtgaaggaatatttctgagcgtggaatacataagattaggaaagaaagcatgagggcgtgagaaaccgatttcttacgccctcatattgccatcgaccaaaacagaaagcaggtggaaccgaacaatggctttgagacgaaagacaacaaaccaaggcggcccctcccattcctggcgccggctggaggggaagggcatgcagcggatcctggtgctcagcggcatttttggggtcctcacctttggcatcctcttttgcaagctctggcagctccaggtggtgcagcatgagaagctggagaataaggccatcacccagcagaccagggagatttcctccacggccaaccggggcaccatctacgatgccaacggggatatcttggccatcagcggctcggtgcagaatgtcatcctctctccccgggacgtgctggccacggtgaaggtggacgaaaaggacgagtttggcaatgcccgctccaaaaccgccatagaggcggagaaggagaccaaggtgcaggccacctatgatctcatcgccgacgagatgtccgagattctgggcctggaccgggaggatgtcatggcccggctgaagaagaccaagtcggcctacgaggtgctggcggaaaaggtggaggacgacgtggccgaccagatccgcgcctttattgacgagaacgatctggagggatgcctctacctgaccgccgactccaaacgatactatccctactccaccatggcctcccaggtcatcggctttgtcaacaaggccaacgagggcgcgtatggcctggaggccctgtacaacctggacctggcgggccaggacgggaagatcatcaccgccaaaaacgcctcgggaacggagatgccttcggcttactccagctataccgacgcggtggacggctacaacgtccacaccaccattgacgccaccatccagatgtacgcagagaagacgctggaggagggcattcaaaagtttgatgtcaccaacggcggcttctgcctggtgatggaaccggacaccggggcggtgctggccatggccagctcgccggactatgacctcaacgaccccaacagcattgtggacgccacccaggcggccaagctggaggagctgaaaaacgaccccaccgtcagcgaggaggagtacgccaaggcactgagtgacgcccagctccagcagtgggccaataagaacatgcggctgtcctatgagcccgggtccaccttcaagcctgtggtggtggccgccgcgttggaggaaggcgtcatcgacgacaacagcaccttctattgcagaggcgcggtcaccattgacaactggaccatccgttgctcggcccgaagcggccacggcagccaatccctgcggaaggccgtgatgaactcctgcaacccggccttaattgatattggaaagaagctgggggcggagaagttctatgaatactgggagaactttggctttaccagcaagaccggcattgagctgcccagtgaggagaagagcacgttctgggacaaggagctctttgtcagcccctccggtgtcacccagctggccaccgcgtcctttggccagcggtttaccaccacgcccatccatctcattaccgccctgtccgcggtgatcaacggcggccatctgctggagccctacctggtccagtcggtcaccgatgccgagggcaatgtggtcagctatcacgagcccaaggaggtccggcaggtcatcagccaggagacctcggacctggtgcgctcctatatggagagcgtggtcaatgatcccggcggcaccggcaagaacgccaaggtggagggctaccacatcggcggtaagaccggttcctcccagaccctggacagcaaggaccacatcattgtctccttcctgggcttcgccccggcggatgacccggaggtcattgtcctgctgggctatgactggccccagcccgcggcccccggagagaacaccaccgcagatgggatttacatcagcggcggcaacatggccgcccccatggccggtgagctcatcgccaatatcctggactacctgggctatgagaaatccggcagcgacgtcaacgccaacggcgtcaccattccccacctggtgggcaagaccccggaggaggcccgcactgccctgaacaatctgggcttgaacgtgcgcctgtccggggagggggctgtggtcaccgaccagatgcccacggcgggcagctcggtgcccaaggggagctccacggtgctctacctgggggaggagaagcccgagacgacggtggagatgcccgatctgtccggcatgacctacgacgaggccaaggcggccctggaaaaggtgggactctatctggaggccaccggcaccggggagagcggcaaggtgttcagccagtcggtgaacgccgggaccgtcctggatgtggggaccgccgtggaagtgaaatttaccgatgacaccgccccggacaacggggtgaccaccggcggcggctgggcccccaaggaagaggaggagtagcccggccgtcggccaaggatgtgaaagggacgatttccgcccaggtcccctgggtccttccgccgggaaggccgggggaccgcgcgccatggaggtggacccttgctgttatcccggcttatccggggcatcgccctgacagaccagattggtcgggacgtggaaattacttctctcacctgcgacagcagaacggtttcccccggcggcctctttgccgccttccggggggagaagacagacggaacccagtttatccaggaggcgctggaccggggggcggcggcggtgctctgcgcccagcccccggaccgtcccggcccctggctgctgacctccgatccccggggggcctttggtcagatggccgccaactggtttggccgcccgggggagcggatgaccctggtgggagtcaccggcaccaatggaaagaccaccaccacatatctgctgaaaggggtgctggaggcggtctgccagaccaaggtgggtctcatcggcaccaaccagaacctcattggccagcaggccctccccgcccagcggaccacgccggatgcctataccctccagagcctgctggcccggatggaggaggcggggtgcacccatgtggtgatggaggtttcctcccacgccctggccctgcgccggacggcggggctgtggttccaggcggggattttcaccaacctcacccgggaccacttggattttcacgggaccatggaggcctatcgcaaggccaagggcctgctgttccagcagtgtcagacgggcatttttaacctggacgacggggcgggacggcagtttgcccagacagcgccctgccaggcggtgacctttggggagacccagggccaggcccaggtactggcccgggagatccggctgtaccccgaccgggtgtcctttcaggtccactggccccagggcagttgtccggtgaccctgcccattcccggccgctttactgtttacaacgccctgggggtcctggcctgctgcctggccctggggctgcccatggaccaggcggccggggccctggcccagattcccggggtcaagggccgggtggaggtggtgccggtgccggcgccctacacggtgctcatcgactacgcccatactccggacgccctggagaaggtcctcaccgccgcccgggacgtgacccagtgccggctgctgtgcctgttcggctgcggcggggaccgggaccggaccaagcgccctgtgatgggagagatcgcggcggcgctggcggacctggtgatcctcacctccgacaacccccgcacggaggacccggaagccattctggaccaggtggcggcgggctttcccccgggcttcaccgcctgggtccggcagccggaccggcgggccgccatccggcaggccctgtccatgggacgggcgggggacgtgatcctgctggcgggcaagggccatgagaccgagcaggagatcggcacccagcgggtccatctggacgaaagagaagaaattgcttcctttttccaacagaatacgctataatatacgttcggcgcgcccgtccccctggcgagaagggggggcgggccccaaaaaagagagaatcgaagttgaaaaacgcggaggtgtaagggaatggattccattctgatcaaaaccctggcggcggtgatcctgggctttgtcatcagtgctgtgctgggcaaatatttggtgcccgccctgcgccggtggaaagcgggccaggccatcaaggaggacggacccacctggcacatgtccaaacaggggacccccaccatgggggggctgatgtttattgcggcggtggccattgtggtgttggtgctcaacggaccggccattctgtcgggggatctcaccagcgtgtttgtcctcctgtttgccctggtctttggcctgatcgggtttattgacgactatgccaagatcaagaagaaggagaacaccggcctgagcgccagccagaaatttctgctccagctggcggcggccattctgttcattgtgctgctgcgcaacagcggaatcctgtcccccaacctctatgtccccttctttggggtggagtggaagctgccctgggtggtgtacatgatctttgccgccctggtcatcaccggcacggtgaacgcggtgaacatcactgacggggtggatgggctctccagctcggtgaccctgccggtgtgcgcctttttcgccgccagctttggctatgcctatcttcactgggaccggccgggcagcgccggcatgacggtgttcgccgcggccctgttcgggggcctggtgggctttttggtgtacaatttttatcctgccaaggtctttatgggggacacgggctccctctttctggggggggccgtgtgcggcatggccttcgccctggacctgcctctgatcctgatcctggtgggcatcatttacattgtggagaccttgtcggacatcattcagatcgtctacttcaaggccacccacggcaagcggatcttccgcatggctcccctccaccaccacctggagatggggggctggagtgagaaaaaggtggtattcgtcttcgccggcatttcgctggtgttctgcatcctggcctttttcggggtcatagggcgcttccccgtcctgtgagacccaggggctgatccgggagggatcctttcgtgccaagaccatttctgaaaacccgcgccaaagaaaccaggagtacagccagactgcggcaggtgcaggggcaggtggatgtgccctttatgctgctgacggtccttctggtggtcattggcctgattatgcttctgtcggcctcctacccttcggcctactacgacctgaagggaaacaccggcggagacccattctattattttaagcgccaggcggtctacgcccttttggggtttggcattatgtacctggtctcccggctgaactaccagggcctgcggggcctggcggtgaccattctggtggtggcctgcctgctgatgctggcggtgaaaattcccggcctgggcatcgaggtcagcggcgccacccggtggctgaaatacccggtgcagtggcagccctccgagctgggcaaaatggggctcatcctctactttgcctcccggctgtcccgaagggaccagcgcacccccttgagcttccggcggaacaccgccgtgggccggtttggcaactttctggagcgcatcggcttttttgagctgatcccctatttctttgtcatcctggtgatgatcggcatcctggcggtgcagcaccacatgtccgccaccatccagatggtggtcatcgcggcggccattctgtttgccggcggcatcgccgtgggctggttcgtggccggcgggatcaccgtgggcgcggccctgacggtcatcatcctggggacggactacatgacctcccggattaccacatggttgaacccctgggacgatcccctggacaagggtatgcaggccatccagtccctgatggccattggctccggcggggtcaccggcctggggctgggcaacgggcggcaaaagtttttgtacctgcccgaggcccagaacgactttattttcgcggtggtctgtgaggagctgggcctcattggagcctgtctgatcctgctgctgtttgccctgctgatcatccgggggtactggctggctcttcacgcccgggacaaatttggatcgttgattattgtgggcatcaccaccctgttcgccttccaggtgtttgccaacgtggcggtggtgaccaacctcttccctgtgacgggcatctctctgcccttcttcagctcaggggggagcgcgctcatcattcagatggcggagatggggctgatcctcagcatcagccggcaaaatcccgtcacatagcccatttggggcgggaaagcgaggaaccgaatgaagattttattgacctgcggcggcacggcggggcacatcaaccccgccgtggccttggcccggatgtttcaagagagaatggaagacagccaggtcctctttgtgggggccaagggcggcatggaggagcggctggtgcccaaggagggattccctctggagacggtgaccatcagctccttttggcgcagtctgagcccgtcctccctccggcacaacctgcggaccctgcggaatctatcggtgtccaaaaaggaggccgcccggattctggacggctttcagccggacctggtggtggggacggggggatatgcctcctatcccgtggtgcatgaggccgcccgccggggcatccccacggcggtgcacgagtccaacgcggtgcccggcctgaccacccagcggctggccaaggtggccgaccgggtgatggtgggctatgaggactcccggcagcactaccatcacccggaccgggtggtggtcaccgggaccccggtccggggggaattcttccgcctgacccggcagcaggcccgggacgccctgggcatccgggatgaccggcccctggtcctgtcctattggggcagcctgggggcggaggtgatgaacggctatatgaccgatttcatccgccgggctgtccgggagggagcccccttccaccacatccacggggcggggcggaactatggggccatgcagaaggccctggcgggggtctccctgccgccggagatccagctgcgggagtacatctatgacatgcccacggtgatggtggccgcggacctggtgctgtgccggggcggggcctccaccctgtccgagctcaccgctatcggcaagccggcggtcattgtgccctcccccaatgtgaccaaccaccatcaggagaagaacgccaatgtgctggccagacaggggggggcggtggtccttctggagcctgtgtgcagcggggacaccctgtaccagaccacccaggacctgctggccgcgccccagcggcggcaggccatggcccaggccatggagaagatggggattccagacgcggcggaaaagatctatgaaaccctcctttccctgggaaatgggaaggagagggccccgtccgccggggcgtgacacccatttgacggggcaggagagcggccccggttcccatatgctcccggtcctgccgggcggtcctggagggaggagaaccaatctctctccttcggcataggatggcctgaacagacaaagaccaggatcgggggagacaatatgatggattattttgcggtggagggcggccggcccctggaggggcgggtcttcgtccacggggcgaaaaacagcgccctgccccttttggcggccaccctgctggccgatggggagagcgtgttacataactgcccggacctcaccgatatttccgcggccctgggaattctgtccggtctgggctgccgggtgagacgggagggggccacggtgatggtggaccccacctgccgccggggccacaccattcccgatgaactcatggggcagatgcgggcctcggtgctcttcctggggtctttgctggcccgggacggggaggcggtggcctgctggcccgggggatgcgccctgggggcccggcccattgacctgcacatccgggcctttcaggccctgggcgcccaggtgcgaagctggaatggacgtctgtccttttatggcccccggctccacggccgccggctggccctgcccatccccagcgtgggggccacggaaaacgccatgctggcggcctgcggcgcccaggggatcacggtgattgacaacccggcccgggagccggaaatcgtggacctccagggctttctccgctctatgggggcccaggtctccggcgcggggaccggggagatcaccattcaggggggctgccggctccacgccggggaatacacggtgatggcggaccgaatcgtggcggccacctacctctgcgcggtggcggccgccgggggagagggggagctgctgggcacccagggagaggacctgggtccggtgctggcagccctggaggccgccggctgtgagaccgggcgcgcccccaaccgactctggattcgccgccggggccccttggggggcgtgggcagcctgtgtaccgggccctatcccgcctttcccaccgatgcccagccccttttggccgcggccctggcggggggaacggggaagagccggatcaccgagaccatttttgatcgccgcttccgctacaccgagggcctgtgcgccatgggcgcggccattcaggtggagggggacaccgcctacatcttgggccggcccctccacggggcccaggtggcggccacagaccttcgggggggcgccgccctcaccgtggcggctctgggcgcccaggggcccagccggatctggggcttggaccatgtggaccggggctatgaggggctggagaccgccctggcggccttggggggaaacattcgccgggagaccggcccgtaaagcggaacaggaaacgccggcctctgcggacgccgggaaggggtacggagcggccgccctgggaccggggcggcgtttcggcctgttaaggggaacaggatatggcaaagaaagaaaaagaacgcagatatcgcaaacggcggggaggcatcgcctacaccattctggcggtcctcctcattgccgcctcggtggtggcggcctgcacggtctttttccgggtggaagaggtgactgtggaggggaatgaacgctactcccaggagcagattttgtcggtggcctcggtggaaatgggggccaacatgatcctcacgccgggggagcagattgcccagcggatctaccgcgccctgccctatgtggaccatgtggaggtgcagaaacgcttccccaccaccttaaagatggtcattaccgagtcccagccggtggcggtgatcaccggcgcggcctcggcctggattgtggacgccaagggaaagctgctggagcaggccgacgagacccaggcccaggaatacaccaaggtgaccgggctggagctgctggagcccgagcagggcgcccaggcccagaccaccccggaaaaccaggcccagctggacggcctgaccgccatgaccacggccctggcctcctgcggtctgatggaggggatgacctccatcgacgtgtcctccaagaccgagatcgtcatggtctatgacggccggctgacggtgaaggtgctcaacaacgtggactttgaccggaaactgaaggccttaaagcaggtcatcgccgtgatcggcgaggagggccgggggaccatcaacatgaagggacaggacaagattatctggtccaaggagaattaattcccccaggggcaggggagaaaaacccagtgttttttcaaaaagatcgagaagttttccaacttttctattgacctgccgaagaaagggagatacaataaaggaaaatctaaaattatcgcattgttcagagaaatacacttaggaggatcgatcatggcgtttggattggataccggagcagagtccgttgtagatattaaggtgatcggcgtaggcggcggcggcagcaacgtggtcaaccgcatggtggaatctggtgtgaagggcgttgagttcattgccgtgaacaccgataaacaggcactggctatctccagcgcaaaccataaaattcagatcggggaaaagctgaccgagggccagggcgccggctccaaccccgaggtgggccgccagtctgcggaggagagccgcacccagatttccaaggccctggaggggaccgacatggtgtttatcaccgccggcatgggcggcggcaccgggacgggggcggcccccatcctggccgacctgtccaaggaaatggacatcctgacggtgggtgtggtgaccaagcccttctcctttgaaggccgccgccggatgcagcaggcggagctgggcattgagaacctgcggaccaaggtggattccctggtgatcatccccaatgaccggctgaagtttgtcaccgagcagaagatcaccctggccaatgcctttgaggtggccgacgacgtgctgcgccaggcggtgcagtccatctcggacctgattaaaaacaccggatttattaacctggactttgccgacgtgtccgcggtcatgaaggacgccggcatggcccacatgggtgtgggacgggcctccggcaagaacaaggccgaggaggccgcccggcgggctgtctccagccccctgctggagacctccatcaacggcgcccggggcgtgctggtcaatgtcaccggctccacggacgtgggactggaagaggtggagatcgccgccaacctggtgcaggaggccgccgatcccaacgccctgatcatcttcggcgccaccttcgacgagagcatggaggacgagatctgcgtcaccgtcatcgccaccggctttgatgagaccattatgaacaagaagtccggttccgccgccccggaaaaaacgggcaaggccgccggacggagtgccgccgcggagagcaaggcctccgaggaggacgacccctacaaggaaatctttaagatttttaaccgggagagataaggtcccgcgatttgtcccatgataaaacagcagcccgccgtgagaaaacggcgggctgctcgtttattgggcgggggagaccaccgggagaatgacggtgcggacccccttgcccatggcgtaggagagggtatttaaggtccctccctgggggatgccgtcatagacggcgatgaggagggaggaccggtccaccatgtaccggttgcgccggttcatacagccgggggtgtaggtgtgctgtaccacggtctccaggtcgcactgatccaacaaagtcatgcggcggcgctggtcggcggcggaccagtggtcggcctggccggcaaaggggatggcggcctccagggtgacctccgggtggcgctgccggaggtccagaaccgcctggcagaaatacaggtcggctccctgggccatgccgcacaggaagtggcggaagccctggcggtgggcctcctccagggcctggtccagccgggctttcagggccaggcaccgggggtcggcctcgttgcgtccccagggaagccggacggggcggtggccggagaagcagcaggtgacagcagggtccaagggaatgcctcctttccgtggcctgtggggccttttttctctatggtataactgggactgtcaaaagtcaacgaaaattcctgccaagatttgactggggatggtaattttgtgggttgttttttggtaggaagacggtataataggattgaacaacgaaataagatgtcttcagggcggggtgaaagtccccaccggcggtaaagtccgcgagccccttggccacaggcccaggagagccgacccggtgcaattccgggaccgacagtgacagtctggatgggagaagacgtgctgacacaccccttttgtgtggtgtcattttggagtgccgcagcgcgggactctgattgcgacgcccccaatgggccagagagcaccgggaagacattggtttttcgggtgttacatttggacattgggagtgtttttttatgaacgaaaaagtacggaagcttgtcaccatggccatgctggccgccctctccattgtgctggtctatgtgatccacttccccatcttcccggcggcctccttcctggagtatgacccggcggatatccccatcctcatcggcacctttgcctatggtcctctggcgggggttctgctgacggtggtggtctccgtgatccaggggatgaccgtcagctccggcagcggtctcatgggcatcgccatgcatattttcgccacctccattctggtgctggtggcggggaacatctaccgggtgaagcacaccaagaagggagcggtgctggcgctgatctgcggcgtgctggccatgacggcgggcatggtggtgtttaactacttcatcaccccctacttcatcaccccggaccttgcggacaccgcggcggtggcggccaaccgggaatttgtgaagaccctgctggtccctgtgattgtccccttcaacctcattaaggcgggggtcaactccgtggtgaccttcctggtctataagaccgtctcccggcatctggtccacggggagaactggaagaaggagcccggtgtgaagcaggcacagccggagcagtaaacagaacatcccgccgcggtgcgcggcggtcaggagaaggaaaagcggcggggcaacccggccgcttttctccgtttgaccggcagagaggagggagggctgtggaccgggtgatttttcactgtgatctgaacgcattctatgcctcggtggagctgctgagctacccggagctgcgggagaagcccgtggcggtctgcggggacccggcggcccgccacgggatcatcctggccaagaacgaggcggccaaggcccagggggtaaagacggcggagaccatttggcaggcccggcggaagtgcccggccctgctgcttttgcccgcccaccatgacaagtaccggtattactcccgcctggccggggagatctaccgccggtatacagacctggtggagcccttcggcatcgacgagagctggctggatgtgacggggaccctgggactcttcggcgg

SEQ ID NO: 2250 - DNA, 13899 bp, KLE1738
atgcggtattagcacaaatttctctgtgttattcccctctccaaggcaggttcctcacgcgttactcacccgtccgccactaaggattcctatccgttgtccgaaaactccgtcaagggtcctccgttcgacttgcatgtgttaagcacgccgccagcgttcatcctgagccaggatcaaactctcaataaaatggtatctaaacagcggctctcaccgctattcaaatcaattcattgatcgctaatcattagcttcaaagaaataaaacgttgccccacaaagccttaaagcttcatggacaacttctacttgtccgttttggtgcttcgtgtttcttacttacgttgtttaatttacaaggtgcacaccgcttctgcggggtgagttatattgtaacacaactccaaccatctgtcaagaagttttttcctcttttctgtccggctttttgccccgtgtctcgcgacagctttgatagaataccactccctccctggaatgtcaaccccttttttcaatttttttcagatttttcgattgctttctcaccaggcacatacagagaacggaaatagccagcgccgccaggtttcccatgggaagcaggttcccggcaatgatctgattccaataggcaatgggtatactgcccagaaggacgacccccgtgattccccagccctgcttcttggattcttttcggcccagcagctgcgctgcaagccgccgcaggcacagaagaaggagcccaagcagcgccgcatcccccagaacccacagcgcggaggccaattcttccagccgctgaaacgccccctcaaatcccagtccggagaccatttggaaaaaaggacggttgatctgggccgccaggtccgcgcccagccgtcccagcaccaggagcattcccgcccccaaaagcaggaacaatcctcccaaacggcgcatgaccgtccctcggctcttctcttccggccggacatcgcccagcaggaagagcacatagccgccggccgccactgtccctcccgcggtgaacaccccctggggcacctgggacagctcctgccagttccagaggaggacctcatcccattgcagccggaacacgccgaacagaaagatcaggaaaaagccaaaccccaccgccagggcaaagacctcacaggcccgggcaaaggcgggcagccccccagaggccatccatccggccagaagcagcgccacggcggtaatcaggatgggggaggcccggagagaatcggacaggcggctgccaatccgggccgcgtgggcagcggtcaggtaaagaccccaaaggagaaagaggcccgccagaacccgtcccgtcctctgtccccatctctgggcaatccgctgccccagatctccctgccccaggacggggcttctccccagcagcgccaccagagccacagcgatgccccccgccagaatgggacacagccacgccgccgcgcccactgcggacaggcgtcctggcagctgctccgtgcccagcgggaacagggccaggaagagcaccgtcatcagttggcgcagagagattgttctgtccgtcatacattatcctccttcttttcccgttcaagatggggcctcccccaacggggcaggacggcacgccgccccttcttctatggttactactgtcgctcggtcacagtgatggtgacagagacctccaccggcagggtagaaaacgccgtaggccactggctggacagcgcctgccaccggaacggattcgacagccccgcccggcccagcagatccgtcgcgtctgcctcggcccgctggagcaccgccaccgcctggtacatggcccgggcggtctcttcctccagtttggccacatcccccgggcggctctcccaaccaccggtgagaaccccctccaggcggcagcggatggacagccctgtcagccgtccctcctccatctgggggaccacccggcagcctgtgctttgcagcaccatggcctgcgcctccacggaaccggtccaatggactcggtctcccaggagaagcgcagcacccagggcctctggtccggtgagccattgtgtgatgccgccctcttgatacagggcaaagccggcaaacgccaacccctgctctcccacctctaaggcaggcaaaaggaggggctccttccgggccaaggccgccgccgcctctcggagggtcactgggcagaacccctggcggttttttccctgggacttgatgacactcatccgcttggcggtgtccgcctccccggaaaaggcctcctccagggtatccgcccggaccacccacagctgggtttccgtgctctgctggggctcctgaaaggcataactgagcagttccggcagggtgcccgccgcgttttgggtgagaagcagatgctccacatgggcacagctcaccacctgttctccccggttggtcaggccctccacggcagcggccggggtctccccctggctgtcacagcggaagggctcctcctccccccggccctccgcagccgccaaaaggtgaatgccctggccggccggctccacccccagaacactgaccaccgccgtggcgccgctctcccgactttggggggtgccggcacagccggtcagaagcaggagcaaaagaaacaccaatgccaacacacgcttcatccctgcctcctttggtttcgggtctttaaggcactctcccggaacttcacccggtgggtgggccagcggatgacgccgtggcccttctcccgctcgctgccggaggcggcgaagggggtgagatagggcaccccaaagctttccagctgggccagccggtacaccagcaccgccgccaaggcggtcaccgcaaacagcccgccgatgctggcggcgatggccaggccaaaccgccaaatccgcagcgccgcggaaaactcctggctgggcaccgtgtacccggcaatgccggcgatggccaccacaatgagcaccaccggggagacgatggaggcctccaccgccgccgaccccaccaccaggccgcccagaatggaggccgtctgtccgatggggcccggcagccggagccccgcctcctgcaccgcctcaaaggccagcaacatgatgagaacctcaaacaccgtggaaaaaggcacgtccgtcttggcctcggagatggaccaggccagccgggccggaatcatctccgggtgaaagttcaccgaagccacatagaaagccggcaggaacagggaccccagcatgcacagataccggagaatcgacagaaaggaggccgcgacccagttttgggagcgatcctgcccggttttgaaaaactgtcccacggttcccggcagcaggtatcccaggggaatcccgtccacaatcacccccacccggccctctaccagaccggcgcagaagcggtcgggccgctcggtgtaggcaatcatgggaaaggccgtgtccacctcgtccacaatgagctcctccagggaagccgtctggagcagatcatcggtgtcaatgccggcaatccgccgcttggtctcctccaccagctccggattggtggtcccctccaaatataaaatgtccacaggcgtcacactctgccggcccgcaaaaatctcggcaatcttcagctctggggcccggagccggcggcggaccagggaggtgttggtccgcagggactccacaaaggagtccttggcccccttcaacgagggctcgttgtccggggcgctcaccgaccgcttctcctctgtggcggcaaaataggacaccatttttcccttccccgggaaatcaaagaccacactgccgttgatcagggcaaagaccgcctggtccagggtggtgcacacctggaccagctgggtgtagacaatgccctccgtcatcatgcggaaggccgcctccggggtggcctcccgcagcagctggctggtggccaaggggcggagaatgtagtcattcatccgttcattgcggacctgtccgttgatgaaaaagacggtggtccgcttctccgggtccccgccgatgaggacctcccgctctccaaagtccgcgcagtcccgaaaaatgaagcggatgtgatccgccgtcaggtccccctcgaaccggggttcctggcgggggtgggggggaatgtcctcccctttggggccgatccagcccatggaaccgcctcctttctttttggtggatgctggtagtatggaccactgccgcccgggttatacagccgcccggcttgacttcctgcccacctatggtaaaatagccataaactcctgtcgccatttcccgccccgttcccggggctgacataagaaaggattgaccatgaaaaaaaagctactatccctctttttggccttgaccctggccctgtctctggcagcgcccgcctgggccgccaccccggaggaggcccaggactccgcccagctgctgtacaacttaggcctgttccagggttccggcaccaacgaggacggttccccccggttcgccctggagcgggcccccacccgggccgaggccgtgaccatcctggtgcgcctgctgggcgcggaggaggccgcccaggcccaaacctggaccacccccttcaccgatgtgccggactgggcccagtcctacgtgggctacgcctacgccaagggctataccaccggggtggagcccacccggtttggttcctccacccccgtgtccaccgcccagttcctgaccctccttctccgggccctgggctatgaggatggcaaggatttcacctggagcaccccctggaccctgaccgaccagctgggcatcaccgacggggactataccgcccagaccgccaccttccttcgggctgacgccgccgtggtgtccgccaacgccctgtatgcccccaaaaagggggaggacaagaccctgctccaggatctgctggactccggggccatctcgggcagcacggtggtcatctgggactacgccccccttctctttgacgaggacttcgcctccttcctgttctaccctgtggacggaagccccgccagcttcacctcctttaagttggataaggtaaccgtcaacggcctgtcctgtcagacccttcaggtgaccaccccggaggaggtctccgcctacctggcctccatcggctacgacgccggcggctttggctatgtggagatcacctatgacgaggacaaggcccaggccgcggccacagagcattacaccgacgaaaacggaaaaacctatcccctgctggccttctccttcacctacaccgccacccaggccgatggaagccaggtgaaggggagcttcaccgacaactattacttagacgaataacccctcctgcccaacagattgccgcgttcccacggcaatctgtttccttacttccatgacgtataaatttgtaatccatcccgttgatctccaagaccacgacggtttcctctcctttctctcccactatgccgggcagggataccaggccgtccaaatacaccggtcattcaccctctttcgcaggacggacaccccgccggcacagtacagcatggcgttttgcccccggacagaccgccttgcagacgggttgcagcccattccagggctccacaacggaatcctcatcgttccacaggcgggctcgcccgaggcacgagagacttggaatcagacggtggttgcggactacgccgcgtttgtcccctacaacctcatctccctgctctccaaaatcattcgctttcttgtcctgccggtggtcgttttgtccgtctttctctccttcgtgaaacccatcctgcaagacaccgcctcccttcccatcccacaggctgtcctctacccccttctcctctttctggttgcctgggtctttgccatcgacctgttcgcctacggcatcaacaccgtccaccggaccggactcaggcaggccattccctccggccgcccgtacgccacgtctccgtccctgcggccccttgttctcctgaaaaacggtctgatgacgttccggttcctccccttgcttctgatttgggggctcctgttggtttcccttttcgcataatcctgctccctatttgaaaagatagagcggccactcaactgagtggccgctctgcgtatgcccacggtctcccttctttttcatatttattaaaaattatatgttatataaatatgcactttatgcaggaattttttgctgttccggcggctttttccatttctcagtcaattctttgaaaattttttcgcccggcgaccaatttcgacaggtccaatcgtattctctttagaatgtgttttttcaaaccaagacaaaggaagtgatcgacatgaggccgcccttggaacgccaggaggcggagcggttggtggaaacctactctgacctcgtcctccggctaagctactcctacctcaatcaaacccaggacgcccaagacatctgtcagacggtcttcttaaagctcctggagcgggccccggatttcgtctcctcggaccacgaaaaggcctggatcatccgcaccaccgccaacacctgcaaggacctgctgaaaagccattggcgccggaccaccgtggccatggaggccgccagccacattcccgccccggagctggaggagggaagcctgtcggccgcagtgaacctgctgccccccaagtaccgggccgtgatctatctgtattactacgaggggtactcctccaaggagatcgcccgccttttgggccgcaacccggccacggtggccacccagctccggcggggccggacccagctgaaagacctattggaaagtgagggttcttcatgaaaacatatcgtgaccagatgcacgggctccagttcaccccagagcaaaaagcggccatggtggatgcccttctggccgccagtcaggcccctcaccagcggcgcccgcagccccgcaaagcccttctgttcgcggcggtggccgcggcggtgatcctgtgcgtcgcctgtgcctccggggcccttcaggccacggtggcggccttttccgccctgtttggcatctcctcccccgcgcagacccaggtcatccaggaccgggcacaggtcatccaaaccagcgacaccgacaacggcgtgaccgtctccatggaatcggtcatgggggacgcccacaacgcgcagatcctcttctccatccggcggacggacggacagcccctgctcccccagcggccggacctgagctggctgatcaaccaggaccacgcccttttgtttgaggaggacagcacactcaacatgtttactccggcagaggacgaccagcccgacaggtatcttctgagcagcgcccttcacttcgtcccctttgaggccaccgattccgttttgtacttcctattttccgtctccagcccaaactatcccctgccctctggagggatgtccctgaccttgcggaatctgtgctcctacggtcctgtgtctggcaaggatgaaaaggggtccatcccgctggtggaggggacctgggacctgtccttccacctggaatacgacacctccaccctgtcccttcccacgggacagaccttccaccacggcccccttacgggcaccgtggaggagatccgcctctcccccatctccatctatctctccttccgctatacctttgaggaggagaccctggccgccggctatgaccccggcgccaccgaactgtccaaagaggcgtggctggaggagcagaagcgggaatggttcagcaacctccctctctacgttaccttccccgatgggaccacccaagacatccagcaggacaccgttgacctgggcggtttctcccagggcagcgtctacaccctctccggcgccctccagaccgtccttcctttggattccatcgccagtttccatctgggggatttgaccattccccttcccgactaaccttctcctcagcgttgcatacaacgcgttcagccaaaagaacacccccttggaaccatcagcctggttccaagggggtgtctctcatgctttttccctttcagcgatagaccgccgcctccttccccacaggggccggccggccggttctggcccggcggaccgccttttctatctcacagaccaccaacggcgtcaccgccagccccaggacgatcccccactggggcaggggcatggggaccacggagaaagccccctggaggggcggcagcaggagcaccaggccctggagcaccaccccggccagaaaggccttgttcatggccgggttggaaaagaagcccaggcggaacagggaggtctcctcactgcgcacgtcaaaggcgtgaaacagctggctgagggtgagggtggcaaaggccatggtgttggcaatggcatagtcatgggtcagccgcagccccagtccgtaggccaggagggtcagcccgcccaccatggccccctgccaggccagccggagggagaatgcgcgggaaaacaacgggtcctgcttcccccggggcggctggcgcatcacggtcttttccaccggctccatccccagggccagggcggggagggagtcggtcaccagattcagccacagcagctgcaccgggctgaggggggcatggggaaacgagaacaccgtggccagaaagatggttaaaatctccccgatgttgcaggagagtaagtagtggatggcctttcggatgttggaatagatcccccgcccctgctccaccgccgccaccacggtggcgaaattgtcgtcggtgaggatcatatccgcggcccccttggccacgtcggtgcccgtcttccccatggcgcagccgatgtcggcggccttgagggcgggggcgtcgttcaccccgtcgccggtcatggccaccacgtggccctttttctgccaggcccggacgatccgcattttgtgttccggggtcacccgggcatagacggaaaaggtctcgatctcctcctccagggtctcctgggggagaaaatccaggcccgggccgtcgatggccttgtcccccggacgaaacaggttcaggtcccgggcaatggccaccgcggtgtccttgtggtccccggtgatcatcaccggccggaccccggccgcggcgcaccgctccaccgctgcccgtacctccggccggggcgggtccatcatgccgatgagccccacgaagatcagctcccgctccagctcctgggcctccagggacttgggcggcccgctctggttgcgctgggccaccgccagcacccgcagggccttggcggccaggtcgctgcccaccccaaggatgcggcggcggtcggcctcggtcatgggccggggcccctgggggccctgtacctgggtacaacgggagagcaccgcctccggcgctcccttcaccgcgatgagggtccctccggcgggcaggctgtggcaggtggccatccgcttgcggaccgaatcaaagggggcctctccctggcggggcatgtcccgctccagctgggccttttccagtccctcccgggcggccatctgggcaatggcggtctctgtggggtcccccacatagcccccgggtccctccttggcatccccgcagagggtgcccagggccagagcctgtccccgcagaccggggctgggggtccagacctctaacacggtcatttgatttttggtcagggtccccgtcttgtccgagcagatgacggaggcgcagcccagggtctccaccgcgggcaggcgcttgatgatggcgttgcgcttggccatccgccccacccccatggccaggacaatggtgacaatggcgggcagcccctcgggaatggccgccaccgccagcgccacggcagtgaggaacatgtccaggatgtcccggtgctggagcatacccaccccgaacatgacggcgcacacccccacacagaccagggagagcaccttggacacctcccccatctttcgctggagaggggtctccccctgggtctggcggagaagaagcccggcgatcttgcccatctccgtgtccataccggtggcggtcaccaccacccggccccggccgccggtgatcaccgtgcccccgatgaccatgttcttccgctcggccaggggggtgtcctggggcagcccgcccccgccccgcttgtgcacaggcagggactcgccggtcatggccgactcatccgcctggaggccggcctcccacaacacccgtccgtcggcggggacgtagtccccggcctccagcaggatgatgtcgccgggcaccagctgactgctctccagccgccgctccagccccgcccgaatcacccgggccttgggggccgagagcttccgcagggcctccagggccttgcgggcgttgtcctcctgggacacggagatcaccgtgttgaagagaacaatgagcagaataatggccgcgtccagccagtcctgcccgcccccggcgaagaaggacagggcggcggcggccagcagcaccaggatcatgggatctttcagctgccccagcacccgccggagcatccccgcctgtttggcctcctccagccggttctccccgtgctcggccagccgcttctccccctcctggaggctcagaccctgctcctggtcggtctccagccggctgagcacctcgtgaagggtatcactgtgaaatgtgtggtccattggtttcgcgctccctttcggaatggttgtccttggtttggatgctcttagcataccggaaggagacgcacgattctgtcagatcttgtgtgggcgcaaaaattttccccgccggacagagggcggggcggcccgcaaaaaaagcaccggccccgctgtccgctggggccggtgctgcgctttggttggaacgccgtcattcctcgggggtactctccccgccggcgtcgtccggggccttctctccctgatcggcggccccctcctcctggggcgccgcgtccttggacccgctgtcctgggcgccggcgtcctcctgggtctgcccgtcggaggtcccatcctgggccgggagctccccgccggtgtcctgctccacctggccgttctcctgctcggcctcctcactggtggtgttcagggtctcccgataggcggtgagcttgtcgtagaagtcccccaccgacagattgtcataggtctcggtggtgaccacctccgcctgctccacccactggccggtgagggtgttcagctggtcctcgttccacatggtccgcaccggcgcgcaggtgggctccagccggagaatgatgtggtagccataggagctctccacaaggccgctgatctggccgggctccagggcccgggtggcatcctcgaactcctggaccatctccccggtggtgaaagcgtacccgtcggggttggccgccaggccggtgtcctcgctgttggcgttcataagctcgtcaaacttttcttccagctgggccgggtcggaaatcgcctggagctgggccagcaactcctccgccttggccttcttctgggcggcctcctcctcggacagggcctggccggtctggctgtcctgggtcagcaggaggatgtgcttggccgccaggacatcgttgtcctgggcaaacttctccaggtcctcctgggtggccgcgccgtccttgccctcctggaacatgccctggagcatgtggtcgtagagcacacccacggagctgaccttttcaaagccgctgtcgctgatgcacatgctcttcaggtaggtctcataggcctcctcgccgcccagctgctccttggcggtggccagctcctcctggtaggcggctttgtcctctctgccgtagctgtacccctccgcctgggccttgcccgccaccacgctgtacaggatcgcgtactgctgggccgcctccttgatgctgtcaccggcggtgacaccctcctggacctccatgtcccacacactgccttggttgtcctcactgtccatggcgctgagatacatgttggcggagtccgcctgctgggccaaccagaacaggtactcctccgcggtgacatcccgtccgttgacggtgaacatcacggtgctgcccttgtaccccatcacatccttcaccgggtcataggcactgccgcagccactgagcaggccggccgtcatggccagcgccaacgcagagcccaggatacggcgcatcattttcttcatgatttttgtctcctttgatggttttctccggggagtttccctggaaagcctccaagctgaaccccggcgccggggcatggctccgccctcccagcgtccattgggttttctgcctttccggtttcctgtcccctttgccggcccgccgccggcaggttgcttgtctggcacggcccggggcgggcgctatgccatcaacaatcatcgcttggcaatgattgtatcatggccggccccatctgacaaccattttccgggatttcctgttccgccgggggagggagcgggccccctcctgtccaattctgcaaaaaatcctgcaaaattctctcgctttttttcctgaaaatttcacgaaaatggatgcaatcccttcgcccatttgctataataagaccagataagaggctctgccaggacccggcggggcaggcagcgtgaaacaatgcactataaaattttacgaatcgagagggatgtaacgatgatctcacatggcaaggatctgaagattttcagcgggaattccaaccgcgccctggcggaagccatctgcaaagagctccgtctgcccctgggcgacctggagtgcggccacttctccgacggggagtgtttcgtctccatctatgaaaccgttcgcggttccgatgtgtttgtgatccagtccacctgttcccccgtcaacgacagcctcatggagctgctggtgatgatcgacgccttcaagcgggcctccgccggccggatcaccgctgtgattccctacttcggctacgcccgtcaggaccggaaggccaagccccgcgaccccatctccgccaagctggtggccaacatgctcaccaccgccggcgccgaccgtgtgctgaccatggacctccacgccgcccagattcagggcttcttcgacatccccgtggacaatctgctgggcagtcccctgttcgtggactactttaaggctcggttcggcgacgacgcggacaacaccatggtggtctcccccgacgtgggttcggtggcccgggcccggtccttcgcccagaagctgggcatgagcatggccatcgtggacaagcgccgtcccaagcccaactcctccgaggtctcctccatcatcggggatgtccagggcaagcgggtcatcctgctggacgacatggtggacaccgccggttccctctgcggcgcggccaaggctctggtggagctgggcggcgccacggaagttttcgcctgcgcctcccatggggtgctctccggccccgctctccagcgcctggaggagagcgtcatcaaagaggtccttttcctcgacaccattcccggcaagcccggcgtaaaaagtgataagatcaagtatctctccgcggcacccatgctggccgacgccatcagctttatctatcatgaggactcggtctcccgtctgttcgtctgacacagccggccccgtcggacgtcccgaaccgggacgtccagcgggtcggtcctcccaacggattccgccgcctgtgggcggcggaattgttttgggcagaggttccctgtttcgattctgttttttgaggtattgcgcgtatgttttcttggaagcgtcccggccccgcagagtggctggtgg

SEQ ID NO: 2251 - DNA, 13846 bp, KLE1738
ccacataagagaaattatgtgacaatcagccccatccgctccatctgccgggcatgaatcaggccgctttccgcagtataaatacgggtggtattcacactggtgtgtcccaaaatatccgccagccgggacaaatccttctcctgggtataaaatgtccgtgcaaagagatgccgaaggttatggggaaatactttgtccggtttcacccccgcgcttttgcacaggactttcatatcccgccagatgttgctccggtccaacggccggcccgaccgggtgacaaacaccggccctgctgtaatcccgttccttttcagatagcttttcaacaaacggcacagcttttccgacaggaaaatgctgcgccgttttcccttgttggcaatctccgcccggccagaggccacggcctctgcggtgatctcacgcagttcagagacccgaattccggtggcgcagatggtctggagcaccagggaaaggcgctccttcctcttcctccgggcggtgttcaccaagcgcacatagtcggcccgggtcagctccctccgttcatcacagaacaaagccttctgaatcttcaaaaaccggaccgtcagttctccccatcccatgaagcgaagaaagccgttgaccgccgccagcatggtattgacagaggccggggcgtaccggccggccaggtcccctttccactccagcagaaccgccttggtcagcgccctgccccggagataggccagcagcgcagcaagatcatggagatatttttgaacggtgctgtccgcccgctcctgttcccgcagataggcgccatagcaccggatttgttttgctgatagcttgtagtttttcttcatcgtgaattcctccttgcctgtagtatgtccgccaggaccatatttgatgggataaaggacagcataaaaaagaaagcgggagccgtcctcaccggacgtctcccgaccctattcccttcttttttgagcgggacaccgcacaaattcttccattttttccggcccgtatagggaaaagaatcctgtcaatactaaggaatgttcccattaaaataccgcaggaggcatttactatatgaaagcaactggaattgtgcgccgcatcgacgacctgggccgggtggtcatccccaaggagatccgccggaccatgcgaattcgagagggcgaccctttggaaattttcaccaacggcgacggcggcgtggtgttcaaaaaatactctctcatgggagggctgggggatttctccgcccaactgtgtgaatccctgtataagaccacaggaaagatggtgaccatcaccgaccgggacgcctgcatctctgtggcggggggcggacgccgggagctgacggacaaaaacatctcccccgccctggcccagatcatggagggccgccagatctaccagcaccaggaaggttctcccgccctgccggtgagcgattacaccgaccactatgtggtctccaccgccgcccccattctctcggaaggggatgtcctgggctgtgtggtcttcctctgtgagaaggaccacatggccgtgggcgagtcagagtacaagctggcccagaccatcgccggttttctgggccgtcacatggagacctgatcctctcccctctgccgtccctgcccctggggctcccttcgggagaccgccccaggcggcaggggcggtttttcctggtctattcccccccacccccgcatacagtggtgacacggacaatgttgggagtggtggaacttgcggactgatattgaagaacgcgcctgtgacctggccctttacatcattgagcaccaggcaaccgtccggagtgcagcaaagcagttcggaatcagcaagtcgaccgtacacaaggacctgtcccagcggctgccggcctttaaccgggctctgtatctccaggtcaaagaggttctggacctgaacaaagccgagcggcacattcggggtgggattgccaccaggcgcaaatataaaggaacgtgaaaacccgttttgcgggagagaaaagggcccttcaggggcagcgcacaggcgcgggaaaggaacgttctttccgcgtctgtgcttgctgtgcagagggccccgcagccctctccccaccaccaaaaaggcgggaacccctccacaaggggttcccgccttcccggacgtttgcattgttctgatcgctggggttattccacagagatcaaatagtggtagaccggctggccgccctccagcagggtgatctccgcctcggggcaggcggcctcaaattgggccagggcctgttccgcctctccctgctggacgccctctccgtagaaaatgctgataaactcgcctccgcgctcctggctctcctgggccagcttttccagggccgtttccatggacttttccgttccgaagagctggttgtccaccagcagcaggtagtcccctgcctgaatggcatttccgtcaaaggaggagtcccgggccgcgtacgtaatctccatggtggtgacctgccccatggcctcctccatggcggcggtgttctccgcctcttccccgtcggggttcatggcaatcatggcggaaatcccctggggaacggttttggcctggaggacaaccaccttcttgtcctccaccaggtccacacactgctgggccgccagaatgatattcttgttgttgggcagcacatagacaatctccgccggcgttttttgaatctccttcaaaatatcctccgtggaggggttcatggtctgccccccttggatcacgccgtccacgcccagatcaaaaaagacctttgccaggccctccccggcggccaccgccacaaaaccgtatttcttttccgggggcaggctctgccggggggcggtctctccctcctgctggagcagttccgtatgctgctggcgcatgttctccaccttgaccgtcagaaggccgccgtaggtgagggcctcctccaggactttgcctggatggttggtgtggacatgtaccttgatgatctcatcgtcgtccaccagcaccaggctgtcccccagtccattgaggaaggcccgcagtgcctcgggatctttttgggtgtcccgggaacagatgaactctgtacagtagccgaactggatctctcccgtctcaaagcccccaaagtccgccttctcccgctgggggacgggcgagggctcctggtcgtcggcaggggccgggattccgtggagttcgtccagcattccctggaggatcaccacaaagcccatgccgccggcgtccaccaccccggcctttttcagcacagggttctggttcaccgtgtccgccagggcctcccgggcccgctcaagggccgatcccagcacatactcaaaggcggtgttttcctccgccgcccggccggcccggtcccccgccagacgggagacggtgagcaccgtcccctccgccggcttcatcaccgccttataggccgcgaccacccccgcgttcagcgcgtcggccaggtcaatgccgtccatggtgtccttgtccttcatcgcccgggagaatccccggaagatcagggagagaatcacccctgagttgccccgtgccccccggagcatggccgaggcgcagagggccgatgcctgggccgccgtggtgggggccttctgccgcagttccgccgcggcggtgccgagggtcaggcccatgttggtacccgtgtccccgtcaggcaccgggaatacattgagttcattgatcttctgcttttccgcgtttagggaagcggacgcgtggacgagcatcgccgccagcgtctttccatccactgactgtaccatagttcctcttctctctcctctcagtcgatctccatggagtccacatagacgtccactgctcggacttgggcgcctgtcatgttccccacggcataacggacctcgctcatgatggagctgctcaccgccgtcagattgacgccggcatccacaatgatgtgcagctcaatggatacggtgtcatcttcctcaaaaatcacgcggacccccttggccatggactcactgcgcagcagatggaccaagccgtccttcttggaccgggctgccatcccctttacgccgaaacagctggtggccaccgcgccggtgatggtggtgaaaacctcgctgctgatctggatctcgcctttatcattttgaaaccgcatacgttgatacccttcctttccgtgccgggcgccgggcgccccagcccttctatgagaaaactgtgggaaaaaatacactttcggattgtatttttgcgtgtgatcaggtaaaatactaccatacactacggaagctgcgcaactgtatcttggaggttttttgtatgaaactcactgaccttatcctgaaaatcaccgcgctggtcctggcggtggccgccattgcctgcctgatcatggccaacatggagcgtatctccgactggatggcctgtctgtgggccaaggttcaggcaaagaaagaactgctctgccgcacctgtccctgtgagggctgcgagagcgacgatgaattcgaggaatgggatatctgaccggcaaccccctgttgcagcagaccggagcggcactgtccgctccggtttttctatgggggcggtctcccctccctccagggaggagagaggcccggcggttagaaagagagacctggatgcttgggcggcagcaggatggggtccatccgcttgaccacggcaaaggtaaacagcgccgtggtgatcagctcgtcccggtcattgcgctgctccacagagaccacgcagatccggctgcccacctgcaggggggtggcccggcagaagaggtaggcccccgccgccgggcgcaggaaattcaccgtgctgccctgggtgacgcacatccggccatggggggccaggctgtgcccggcgatggtgtcggcaaaggccaccagcaccccgccgtggacggtgccgtactgctgctggttgctctttcggatcatcatgatcccctcggcggcatcctgttccatgcggatcaaatgaatgccgttctccaccgcccaggggtccagcccccggattttgcccagctgggggtcttcctttacgtaatagagcccttctttatccaaggaagccattgaggatctcctcctccgcctcttcctctgtgaggcccagggtcatgagcttgagaatctggtccccggcaatgcggccgatggcggcctcgtggatcagctgggcgtcgggatggttggccgtcagggcggggatggcctggattttcgcatgccccatgagaatggagtcgcactgcacatggccgaagcccgcggcgtccccaatcatccggggatagaaaatctgctgggactcgtcctgggccaccgaccgggagatcacccgtccgctggccccctcgcccgccaggatcacatccatctcggactccgccacctgcttgccgtgggtcaggagcttctcattgaccaccgcttccgcctcttccttcaccaccactttggtgtagcgtttggtggagtccaccccccgcagctgggtggtgtccagctggatggaggcccctttctccaggtagaccactgtctgggggttcatgatccgctcgccggttccctctccctcgccgtagtgcttctccacgtactgcaccttggagttctcccccacgtaaaaggtgtgcaccccgtcgtgctgggaggttttgtctccggcgttgtggatgccgcagccggccacaatcaccacgtcgcagtcgggcccgatgtagaagtcgttgtagaccagctcgtccagcccggtctcggtgatgatgacgggaatgtggaccgattggttcttggtcccggccttgatgtggatgtcaatgccggacttgtccgttttggagacgatttcaatattggccgtgttgctgcgggattccagctggccgttttttcggatgttgtaggcgccctttggggtcccttccaggtccgcaatctcccgcaggagacgggtatctatcttgttcatgggttaaccctccttcggttgccggcagttcttgctgttcggctgtaaaaactggcacatgcccgccgtgtccgccagaatgtggggcatgatctcctccttgggtccatggcggaccaccttgcccccggagatcatgacgatctcatcggccaggtcgatgatccgctcctgatgggagatgacgatgatggtgttctcccgggtgccgtggagcatgcggaaggtctccgtcagtttggcaaaggaccacaggtcgatgcccgcctccggctcgtcaaagatgagcaggccgccgggccgggccaggatggtggcgatctcaatgcgcttgacctccccgccggagagggaggtgtccacctcccggtccacgtagtcggccgcgcacagccccacccggttcaggtaggagcagcactcgtcccgggtcagcttccgcttgcccgaggccagctccagcaggtcccgcacccgcagccccttgaaccgggggggctgctggaacccatagctgatccccagcttggcccgttcggtgatggacaggccggaaatatccgtgccgttccagacaatctggccgccggtggacttggccaggcccatgatggtcttggccagggtggtcttgccgccgccgttggggccggtgatgacgacaaacttattgtcttcaatggtcaggtcgatgccccggaggatttctgtcttcactccgttgtcctccacctgataggaaagtcctttcagttccaacatatcgatagctccttgtcgctattgtaatcataacacagctctttgtggttttctgtcttttctgaacgtcaaattataccataaaatttgtgggtaggcaatagagtcccctttattttcctgtcagcttgcacagggtcattttcccctttcttttctcgtgccacacaacttcgtcaacattgacaatatttttctctttcggttgacttttcatacaatcattggtacattagacccatatttcatcgagatttccggccccttgccggaccaagagagagaaatgagggggagcacagcattatgatcgaacgacttgggtttgacaacgaaaaatacctggaaatgcagtcggagcacatccgctcccgcattgatcagttcggcggaaaactatacctggaattcggcggaaaactctttgacgacaaccacgcctcccgggttctgccggggtttcatcccgactccaaaattcgcatgctcatgcagctgaaagaccaggtggagatcgtggtggccgtgtccgccatggacctggaaaagagcaaggtccggggggacctgggcatcacctacggcaccgacaccctccggctcattgacgcctttcggggctttggcttcccggtgggcagcgtggtgctcacccggttcagtggccagcccgccgcggaaatcttccagtcccagctggaggccctggggctgaaggtctaccgccattactccattgagggatacccctatgacatcccgctcatcgtcagcgaggaggggtatggaaagaacgaatttgtggagaccacccgctccctggtggtgatcaccgcccccggcccgggcagcggcaagatggccgtgtgcctgagccagctctatcacgagcacaagcggggggtccaggcgggatacgccaagtatgagaccttccccatctggaacctgcccctccggcatccggtgaacctggcctatgaggccgccaccgccgacctgaacgacgtgaacatgatcgaccccttccacctggaggcctacggggtgaccaccgtcaattacaaccgggacgtggaaattttccccgtgctgaaaaccatgtttgagcggatcgccggctcctccccctaccagtcccccaccgacatgggggtgaacatggccggctactgcatcttcgacgacgaggcggtctgccaggcctccaaggaggagatcctccgccggttttacgccgagcagtgccgccaccgccggggtcgcaccgatggcaccgcagtctataaaattgagcttctgctcaaacagctggggctgagccccctcagccgcagcgtggtggcccccgccctggcggtggccgagcgcacaggagaccccgccgccgccatggagatgcccgacggaaagattctcaccggaaagacctccgagctgctgggctgctcctccgcccttctgctcaacgccctgaaatacttagggggcatccccgacgaggttcagctgatctccccctctgtgatcgagccggtccaggatctgaaggtcaacgtcctgggcaacaagaatccccgcctgcatatcgacgagctgctggtggccctgtccatctgcgcggtcaccgaccccaacgccaagcgggcggtgcagcagctgcagaagctccggggctgcgaggcccacaccacggtcattctctctgaggccgacgaggacagcttccgccggctgggggtccgcctgaccagtgagcccaaataccagacctccaagctctatcacggctgaccctcccccgccttccccggcccgcccagtgcccccatcgtgatttgaacctcattccgaaaggagttatccatgatgtccaccaaaacctatattcccgagcattacgcccctctgctgaacctctatgacacccaaaaggccatcggcctgctcaagcgggtgttcgaggacaccctctgcggcagcctccaccttcgccgggtctccgcgcccctgtttgtggaggcctcctccggcctcaacgacgacttaaacggcgtggagcggccggtctcctttgacattcccgccgccgggcgggaggcccaggtggtccactccctggccaagtggaagcgcatggccctgtaccactaccacttcccggtgggggagggtctggtcaccgacatgaatgccatccgccgggacgagatccccgacaacctccactccatctatgtggaccagtgggactgggaaaaggtcatcgccccccgggaccggaacctggactacctgaagcacacggtggaggccattgtctgcgccatggcggacacccaaaagaccctgcgctcggtcttcccccagctgagtgtcctgccccaggtccacaaggcggtctccttcgtcaccacccaggagctggaggacgccttcccccacctcaccgccaaggagcgggaggacgcctgggtgaaggaccatcccaccaccttcctcatcggcatcggcggggccctgcagtccggcaagccccacgacggccgggccccggactacgacgactggaccctcaacggggacattcttctgtgggatgacctgctgggccgggccattgagctctcctccatgggcatccgggtggacgccgccgccctggaccggcagctgaaaaccgccggctgcgacagccgccgggaactcaccttccacaagctgctgctggaggacaagctccccctcaccatcggcggcggcatcggccagtcccgtctgtccatgttcctgttgggcaaggcccacattggagaggtccaggtatccacctgggacgacgagaccatccagacctgccatgacgccggcatcattctgctgtgaatctgtccaatagaaaaacggcttcccgcactgggaagccgtttttctattgggttgcatggcggctgcctcccctccctttgggggcagcgggacagtgggtgaggtcattgctctggctcctgggcggcggccagctcccagccgatgcggatgccggcatggaagccggcctcgaagtagagggattccaggcggcactccgcatccatgatccctccctggagctcttccagcacagccgcctcccccctcggaggcaggtcgctccagtcggtggtgagaatcttgtcacggtacgctttcatcgctgcctcccaggcatcctccgcccggcggattcgctcccacagggtaccgtgctccacggccttgggggaaagcctgccccccgtgcgcaggaacgcacacaactgttgtaagttcaatcgttcgaaaaaatctttttcatacattgcgtagccctccttatcccacaatataacattatatatattgttatgtcaatggcttgcacgatatctcttgatatcgctataattggcatgatatctaaagggggtaaaaaccatgagcggataccgcaaccgaacccaatggacaactgccactgacaatgagctgctggagaaatttcgccaattatccacgcaaacccgcatccccgcctcccgtcttttggacgaggccatcgaggacctgctggtgaaatacgccgtcatgaccaaggaagagaaaaagaatccataagaaagggacgccaccgctatgacaaccaaactctacgaccaggacagccactgccgcaccttctccgcccaggttctctcctgcacccccgtccaggggggacagtggcacattgtcctggatcaaaccgccttcttccccgagggcggcggccagcccggggaccagggcaccctggatacggtccgggtgctggacacccgggagaggggcgacgccatcgtccacatcaccgacggccccctgacccccggcacttccgtcaccggggaactggactgggccctgcgctttgcccggatgcagtgccactccggggagcatgtgctctccggcctggcccacagcctctacggctgcaccaacgtgggcttccacatgggggaggaccaggtgattctggactttgacaaggagctcaccccccagcagctgacggtgctggaggaccgggccaaccagctcatcacggaaaaccgcccggtcaccgcccgctatcccaccccggaggagctggcggccctggactaccggagcaagctggacctgaccgagcaggtccgcatcgtcaccattgccggctgtgacgtgtgcgcctgctgcgccccccacgtaacatgcaccggggagatcggcctggtgaagctggtggatgccatgcgccaccggggaggcatccgcctttggatggtggccggccggctggccttggcggactatcagaggaagcaaaccaacatcgccgccatctccgcggccctgtcagtgcagcagccccaggcggcccagggggtggagcggctgaagcaggagctccagaccctgaaggaaaccctgaagcagacccgccaggcgctcctggcggaaaaggccaaagccctcccccagacccccggcaacctctgcctctttgaggatggcctggacggaaccggtctccgggtcctggccaacgcgggcatggaacggtgcgggggcatctgcgcggtcttcgccggcacggaccaggccgggtaccgctacgccatgggcagccaaaccgtggacctccgggccaaggccaaggcgctccaccaggccctggggggaaagggcggcggccagcccaccctgatccagggcgcggtgaccgccagccgccaggagattctggcctacttccgctgaccacccggagaaaggaggcgccccatggcgaagaagaatgcccggaacacccgggggaaaatcgtggaggccgcctggcagctcttctacgagcagggctatgaggacaccaccgtggaggagatcatcgagtcctcccacacctccaagggctccttctaccactatttcgacggaaaggacgccctgttgagcaccctcagcgacctctttgaccaaaaatacctggccctccaggaggccatggacccggccatgcccgccatggacaagctgctctttctcaaccgcgccctgttccgcatgattgaaaacagcgtctccatggacctgctggcccggctcctgtccacccagctggtaaccaacggggaaaggcacctgctggaccacaagcgcatctactaccgcctgctgcgccggatcattgccgagggacaggccgcgggccagctctcccaggggcgcagcgtcaacgacatggtgaaggtctacgccctgtgtgaacgggccctgctgtacgactggtgcctgtgcgggggggagtatcccctgtgtgactacgccgcccggcaaatgccccattttttatgtgattttctccctctcccttcgtctaagaatggttcaggcgaaaacccttgatttttctctattttttcagaaaatacagaacacggtatagactaaagtctataccgtgttctgtattgcgttctttttttcgtcatggtatgatagaatcctattctgtttctggtcgttcccggcgccttcccacggccctgggccggccggctatttttgaggagaggaaagagagataccatgacaacatcccaattctgtatcattgcgaccattgtggtctatctggtcgccatggtgctggtgggggtctattgcagccggaagggcgggggctccagctcccacgagttctacctgggcggccgcaaactgggtcccatcgtcaccgccatgagcgccgaggcttcggacatgagcagctacctgctcatgggtctgcccggcctggcctacctgtgcggcgtggccgaggtgggctggaccgccatcggcctggccatcggcacctacctcaactggctcatcgtggccaagcgcctgcgccggtactcggccaagatcggcgccatcaccatccccggcttcttttcccagcggttccgggaccggcgcagcgtgctctcctgcatcgccgcggtggtgatcctgatcttcttcatcccctacaccgcctccggcttcaaggccatcggcaccctgttcaacagcctgttcggcgtggactaccacggggccatgatcatcggcgccattgtggtcatcggctacacggtgctgggcggctttttggccgtgtccaccaccgacctgatccagagcatcattatgacctttgccctgatcttcatcgtcctcttcggcatccagcaggccgggggatgggaactggtggccgccaatgccaactccctgcccggctacctgaacttcacccaggggtatgacgccgccacaggacaggccagctcctacggcgccctgagcatcgcctccaccctggcctggggcctgggctacttcggcatgccccacatcctgctgcggttcatggccattgaggacgacgccaagctgaagacctcccggcgcatcgccaccatctgggtggtcatctccatgttcatcgccgtgctcatcggtattgtgggcctggcggtcaccaaagccggcaaggttcccttcctgggcaccagctctgagtcggaaaccatcatcattcagctgtccaacctgctcagccagcacggcattttctttgccctgatcgccggtttggtcctggcaggcatcttggcctccaccatgtccacggcggactcccagctgctggcggccgcctccagcgtgtcccatgacctggtgcaggacttcttcggcaagaagctcaaccccaaggcctccatgctggccgcccggggcacggtcatcggcatcgccatcgtgggcattttcctggcctggaacccggacagctccgtcttccagatcgtctccttcgcctgggcgggcttcggttccgccttcggcccggtggtcctcttcgccctgttctggaagcggaccaacaagcagggcgccatcgccggcatggtcgccggcggggccatgg

SEQ ID NO: 2252 - DNA, 13188 bp, KLE1738
gggacaccacggagcctaccaccgacgaggcgaacaaccagagcgaacccgcctccaccaccgccaccgacctgaagaccgtcaccgagggcgtgctcaccatgtccaccaacgcggctttcccgccctatgagtccaccgacgacagcggcaatgtggtgggcattgacgcggacatcgcagcggccatcgcggaaaagctgggcctgaagctgcagattgacgacatggactttgacggtgccctggccgccgcccagagcggcaagagcgacatcgttatggccggcgtcaccgtcaacgaggagcgccagctggttttggatttcaccgacacctatgccaacggtgtgcaggtggttattgtccccgagggctctgatatcacctccattgaggacatgcagggcaagcgcatcggcacccagcggggtaccaccggttatatcctttgctccagtcctgtggaggacggcggctttggcgaggagaacgtggttccctatgacgatgccatcgctgcggtgaaggctctgaaaaacgggcagatcgactgcgtggtcatcgacaacgcccccgcccaggagctggtgaaagccaaccccggcctgaccacgctggagaccgagtacgccaacgagaagtatgccatcggcgtggccaagggcaacaccgccctgctggacgcggtcaacggcgccctgaaagagctcatggaggacggcacgatccagagcattattgacaagtacattcccgctgacgcaggcagtgcagaggcggaataacctgtgatggttcagaaaagggcggcatgcgccgcccttttcctttcctcccgcaacccatagaaagagagaggtgaacgcccgatatggaggaactctacaccacatggaaagccatcggcgttgctggcggagacctgagttttttccaggatttcttcgtcaagttttaccaggcctttattgagggggaccgctggctgcaatatctcaacggcgtcaagaccaccctgctggtgaccgccctggccctgatcctgggcattgtcctgggggtcctggtggccatgctccgcaccgcccacgaccagcagcgccccggtcaccgcaaccccattttggcggtgctgaatctgatctgtaaggtctatgtcaccgtcatccggggcacccccatgatggtccagctgctcatcatgggctttgttatcttcgccagcagccggaactttaccatgatcggcaccctgaccctgggcatcaactccggcgcctacgtctcggagatcgtccggggcggcctcatgtccgtggacaaggggcagatggaggcgggccggtccctggggctgaactacatgaccaccatgcggtttattgtcattccccaggccgtcaaggccattctgcccgccctgggcaacgagtttatcattctgctcaaggacacctccctcatcacggtcatcggcggcaaggagctgctgtatgccgcccagggcatttacaaccggacctatgagcagatgttccccctgatcggcaccgcggccctctacctggtgctggtcattatcctcagctggcttctgggcaaattggaaaggaggctgcggcaaagtgatcgacgttaaacatctctccaagtcttttggggaccacctggtcctggatgacatctccgagcacatccacccgggggagaaggtggtggtcattgggccctccggctcgggaaagtccaccttcctgcggtgcctgaacctgctggagatccccaccaaggggagcatcacctttgacggcacggagatcaccgatcctaaggtggatatcgaccgcatccgccggcagatgggcatggtgttccagcactttaacctctttcccaatatgaccatccgcaagaacatcaccctggccccggttcagacgggcctgatgaagcaggcccaggccgaccagcaggccatggagctgctgcgccgggtggggctggaggacaaggccgacagctatcccaaccagctctccggcggccagaagcagcggatcgccattgtccgggccctggccatgaagcccaagctcatgctctttgacgagcccacctccgccctggacccggagatggtgggcgaggtgctggacgtgatgaagcagttggcccaggagggcatgaccatggtggtggtcacccacgagatgggctttgcccgggaggtgggggaccgggtcctctttatggccgatgggaaaatcgtggagcagaatacccctgcggagattttcagccatccccgggaggagcggaccaaggcgttcctctccaaagtgctttgagaaaacgggaaaccgctctgccgtgtgctgcggcagagcggttgttttttgcctggggggcctgccagggcgggggccattgtgggtctttgcgcacgccgttggaacggcagggaacgatggcttgcccagccggggccccatttcttgggaagaaatagggccccgcccgggagggcaccgttcccgcccgttccaacggcgcagaaaagcccccaagaaaccggaagccgccgcgagattcccccgcggcggcttcttccatttctctctctttgctgatctggacgaggctcagtaggccacgccccagtagatcatttttttggcggcccgcccgcagatggggcaggtgtcccccagatgctcctgggcaaaggggatgcagcgggaggtcatgccggcctcctccttcatcttcagctcgcacgccagctccccgcaccacatggtcttgataaacccgccgtgctgggcctggagggccttggcctcctccagggagtgggcctcgaagatgtgctcctccaggttcttcttggcccgctggtacaggccgtcgtggatggcatccagggtggcggggacggcggtctccaattcatccaggctgatgaaaaccttctccccgctgtcccggcggaccaggacgcactggttcttctccatgtccttggggccgatctccacccgcaggggcacgcccttcatctcgtattcggcggccttccagcccatggactggtcagaggaatccatcctggcccggatgcccgcggccttcagccggtccagcagggcgctggcagcctccaggactccctccttgtgctgggccacggggatgaccatggcctgaatgggggcgatccgggggggcaggaccaggccgttgttgtccccgtgggtcatgataatgccgccgatcatccgggtggacaccccccaggaggtctggtggggatagtgcagggtattgtccttgccggtgaaggtgatgtcaaaggcccgggcaaagccgtccccgaagtagtggctggtgcccgactggagggccttgtggtcgtgcatcatgcactccacggtgtaggtctcctcggcgccgttgaatttttccttgtcggtcttttgccccttgaccaccggcatggccagaacattttccaggaagtcggcgtagatgttcagcatctgctgggtctctgcccgggcctcctcggcgtcggcgtgcatggtgtggccctcctgccacaggaactcccggtggcggaggaagggtcgggaggttttctcccagcggaggacggagcaccactggttgtagagcttgggcaggtcccggtgggagtggatgacgtttttatagtgttcacagaacagggtctcagaggtggggcggatgcagtaacgctcctccagggggtcgctgccgccgtaggtgacccaggcgcactcaggggcaaagccctccacgtggtccttttccttctggagcagggactccgggatgagcatgggcaggtagacgttctcgtggcctgtctccttgaatcgtctgtccagctcggcctggatgttctcccaaatggcgtagccgtaggggcggtagatgaacatgcccttgatggaggagtagtcaatgagttcggcctttctgcacacatcggtgtaccactgggcgaagtccacctccatgtcggtgatctgttcgactttcttcttgttgtccttagccatagttcccatcctttgatccaaaatcccggcctgctgggccggtcgatctctgtgttgtgaaatgatatattcagatagaatctattttatgtcccaaggggaaaattgtcaagtctcttgtgcctctatggggggccgctggcggggcggcgtggggtgtttccccggcgttcgacggtttgccccaattacccaattaaatccataggaaaaaggaagcgaggagaaaatcttgtgcaatctccatgaaaggtgtcaaataaccacaaaaaaacaacattttagaaacaaaagaaaggaaaagaatttcctcaaaagggttcccagggaaggggaagtatgctatgattacaaaaaagttacagagtgtaacagccgccttgccaatggttacagatggcaacaaggcggcctgtttgagaaagcccgtggatacaaaggagagattggatgcggaagcggattctgagcgtggtactgacggttttgatgctggcggcgatggttccatcggccatggcggccaccctggaagagatcaaccaagatgaggtgttcctcaagcagcagcagagagggacctgcaccctggcctccaccgccatgatgctcagacgggccgccatgctcaacggcgatgagaactgggcccagatcaccgaggccagctgccgggaggcattctggctgtccggccggggcctgccctacaacttctcctatggggagatgaccgtgggccatgaccgcctccccgggggtcaggccaacgaagcggtcctcattgacctgctggaggagcaccctgaggggatcatgctccacgccgcctgcgttccccacggcattctgctcactgagtacaaggatggacagttttactgtgccgacccttcggagtatgccgaggccgggatcatccccattgaggaggcctggggcacccgggtggagaactccaacgcctattggtatgtgacctcccaggtggcacagccccaggagaaaccggtactccccgccccctcggtggaggtggaggactccgtgtctgacctgatggcacctttggccacgcaggaaaccgaaactgcggcctgcctcatcggtcaggcgctggtggagcagaacggaacaaattaagagagtacatgcccccaggctgaagcctgggggcgtttttttgcttgggggagaacggcggtcaggatttccaggatagggtcagggcacggtccttgcgttccaccacctggacaggggagccggtggtcagtgtgtccgcgtccgctgcgtgccagccatagacttgctccagactggtggcgtagtcgccttggtagagaatggtcccttcccggtcatagatccacagggacaagccggtggtgagggtttccccgtcgtagatgcccagcgccagcttttccccgttccaggcggcccgggcgttgcagaccgggaaggagaggaggccgtcgggcaggcgcccggaccagcggtactgatagtgcccttccggggtctgagagaagaagtggaaggtttcctgccccagggccagaagacagttctcccccggaagcacttgggttacgtcgtattgggtgcgggagagaacctcgtcttcggcagagacggaggcctcaaggtgctgggtgggtttgccggcgggaatggaaaacgcggttcgcaggtccatggtctccgtgtccaggaccaagcagcgcgtttggccttcctggatggtgaccaggaagagggtgtcctcctggggagagagggtgagggagagaaccgacaccgcccgagggtccaggggatagaccatctccaggctgtccgggtctatttggacgcgccccccttcccccgtcaggaagcgcagccggtagagcccatagcccccggggacctgctgaaagtccgggagggtgcttcccgtctgtgtgctgggggtcagggtgaaataggcggtgtgcgccccgacggtgctgacggtgccggtgagaaattcttcgccggtgggcgcaatggccagctgggtcagaagaccgtcctggtccttggtgacggtgaccttccaacgggtgtccggggcgaaggggaagcggaaaaacgcctgaaaggcctcctgggcggagggatcaaactggctctcaaaggtctccgcttgggagtagtcaggggattgcccggccaggtctaaggtcacctgaaggggataggcgtccaggaactgactggggttcaggatctccgtccgggtctgtccgggcggagtacggcgggccacctgttcatacagggggcccagcgcgggacttgtggggaggttgtccaggaagtatcccggttcggcggacaacgtggcgtcctggtgggggaagcggagatagaccccggcgtcgtcgttggcggcggcgggaacgtctctttgggcagagaaagccgtggtgctctgggccgggcggtccaaggggatggtcaggtcccagagaagggtttgagcatactggcagctctgggtggccacaaggccctgggcggcggcgggatctccctggcgggagatggcggtgacagcgacttggccggcgtcctcctgcagggtatgggccgccagggccaccccgcccagcaccagggacaggcagaggagaaaggctgcgatggcttgtttcatggcaaaggctcctttccgttggtcagttgggttaatgcccgggaaacccggtcggcttggtagtgataggcacgcttcacataggagaggaggtcggcacccgtttcctccagcgccagggggtccaggtcggccactaaggttccctgccggagcaggagggcccggctcaggaagggggcggtctcctccagcagatgggtggacaggaggagggtctcttggggctctaaaatccccaccaggaccttgtaaaagtcctcccgattgaacagatcattgccggcgaagggctcatccatgaggatgtagtccgcgccctggctgagggccaggatgacctcaagctggttctgctggccggtggagagccggcccgccgccttgtgccggggcagttggaagaagtccatcagcccgtcatagcgggcctgccggaaccggggaaaatgcccggcgtaaaaatcccggtgggcctgggcggagagggcgggaaagaaggagtgctcactggtggcaaaggacagtttggcatagtcctttcgggtgagggggcggtcgtccaggaggatttccccctgaaaccggtgcagccccagaatgcacttgagcagggtggttttccccgcgccgttctcccccagcagccctacgatttccccccggggaagggtgagggagaggtccttcagggcgtgccgtttgccggggtaggatttggagaggtgtttgagttccagcatcagtaatacatcctttctggccgggcgaaggggaggaacaggttggcaaagttatcccacagcttgtccagctgcccggggcgcagagcatcttccggggtcagatggaggtagattccgtagaaagcagggagcagaatgaccaccaggagcagggcacaggccacggtgagcagggggatggccaggcaccggcgggccagctcccagcggtcgggcagccgccgcatgaggtagatgctctttgccccccgccaaaaggcgtagtaattgcagggaatcaggagcagtgcggccaggaccaccagcgtcagcgggaagaaaaccggaggtgtccagaaagaggcgctgtcgctctgggcgccgatcaggtcggcaaagtccgtcatacggtggagggagcgggccgcggtctccaggccgtgggtcagcgcagcggcgtatttccacacgctgtataaaaaagcgcaaatcataaccaacagacagagaaggccttgcagctcccccgaggttcccggcggaaccaagtcacatagtttccagcgtttcatcggcggtctcctttcgtttccggcgcagcagcagcccgaccaagaggcacagcgcggcggccccggcgatcatctgggggcggcctccgggcaggaagagaaaacagcaggcggccagaacaaagaacgtgaaattctttcgtccccggtggagcccctcggtgaacagggccgcggtaaaccccagcccggccgccagggccgcattgctcacccaccggccgggcaggtccagggggaggaagaagtgaaagaggtccagttcccagacggtgacatagagggtttgcgtgcccaagaaacctccttgccggccgtaataccagccgatccccacaaggaccagggcctgcaccccccagaacaggagatagaccagggtgttgtacaccccctgccagaagaccacccagcccggggacagggggagccgggccagggtgtacccaggacggcgggcgccccgcccggtggtggccagcagaagcagggcactgagcagcagaaaggccaaggccaaaagccccgccagtgcgccgccggacagggagaaggcatcggccaggcctatggaggccgggtccggggagagacagagaaaggcgctccactgggccgctgccaggaggagcagcagaagcagcaccttccagacggtgtggcgcagaaccagatggaagagtgcacgatgtggtctcatggggtctctccctccttccagagctgatccaccagggcaagggcctcctgccgggacaggcccatgtgtttcatggcggcgatggtatcccggacctctgcctggaggagttccccccgcacccggctctgggccgcctcatcggccaccacggtgctcttggccccggtgtgggacaggataaggccctcctcctccagcagccggtaggccttctggacggtgttggggtttacccccagcagggccgacacaacccgccgggaggggagttcctccccgtgggcgatggtgcctccggcgatgcccagcttgacgtagcgcagaatctgctggtaaatggggaccccgtcggccaggcttaggtgcgaaaaggagagcatgggaaccacctgctttctcactgtattacaggaatagtacggtttacaaccgtattataagcataatacggttgccttgtcaagagggaagttgcctttgcatggaaacgggcatgaagtcaacgataaaaaacccatccatgtggagctatttactccacatggatgggtttggatcagagagggaagcggcaacaagggcgggggcaaaaggacaccccattatgccatggcagaggaaagggagagcgtcttatggtcatagaaatactggagatgaggggggaccctggagccgtggagggagagggtgacccgtcccgtctggccggggccgatggggagaccggacgccagggctgtggtggttcccccgttgtaaaagtcgccgttgatgacatactccagctgggtgttcccccggagccaaacctggatatccccgtgaaaggaccggttctgctgggaggtgttcccctcctgctggaggagctggatggcgtccacggaggcaagggaggcgtcggcctccgagacggcgcagtagaggatcaggcggggggtatacgaggcggtgacggacagggggagggaaaggatgcggtaatgggcctcctctgccggttcggcatctgtcccggcggggaatgctgtgcgggccgcctggtaggagaggccggcgtttccggcgtactgtgtgaccgcctgggagaagggaatggcatcgctgacagccacgacggaactttccccaggttccccagcggaagaagaagaggcatcccccggggcaggggagggattatcccaggcacaggcggcggtcaggcatagggcaagcagcaagaaggaaaaaagtatcggtctatattgtttcatgtaagacagcctcctttcttgaaatcattcaaaaaacccgcctcggagacgtgctccaaagcgggttttctgcgcgcttagtcaaagcccaaccccagataggcgtcctgctgggcaaagtatttggaatgcagccccaggtcgtaccacttaatcatgccaaaggcctgggtgtagctgccgggcagcccatcccagaaggcgggggtgcggatgtggtagcgggaggcctccatttccttggcgatggtctccaccgccttgcccatcttatcggtgggaatgagcagttcctttgtcagcaggcggcgcttctggacatactcaatggcggcgcagcccaccacgccgtcaatctcaattttatacagatcgccgtaggccaggtggctgccgatctgctggaaggagatcatctggtcggtataggtcatgtggaaggtgtttttcagatacccctcccgaatctcgttgtactcccggggggagacaggggtcataaccccgccgccggtatccccggagagggcggaggtgagaatctccaccttgcgggtggcgaagcactcgtccattcccacggcctcgaagaaccgatggagggagggggaggcggggaccaggaccatggctttgtcccctcgtttttgaagaaaatcgtcggcgtagcgcagcagctgccgggcgtggcccttgccctgcatataggggttggtggccagggcgtaaacataccccacggggacctctgtcccgtcgggaagttggatggcgccggggagcatggccgccatggagtccacctctccatcgtcatcgaccaccaggacctggtcaatggagcagaacttctggaaaaagatatccacataagcgccgggatctccaaagcactttcgccagagatctctcagctggggcagttcttccggggcagcggtgcggatggtgatcatgggggtgtcctcctttgtttcagatcggccgccggcgggcggcccagggaatcagggagcgcggcactccaccgcgctgaaattgacttggagatagtcgggggcgtaggacagcttggctttccgcaggccgggcagccccatgtcgtcctcccggtccaggtagcggatatgggggtacttctgccggatgtaccgggcaaaggaccggttcactgcggggtaagccccctgaatctccccccgggcccgttcaaaatggacgtcgaagatggtctcggtgaggggggcgcccaaggtgaagcctaaaagggtgtcctgccaccgcaggacaatgccctccagccccagggccggcaggtgttccagggccagcaccagggcccggtgctcgtcgtccagggtggacaggccccggacggtctcccgggtcagggcatcctggtgccaagcggcgtccatggccaggcaggcggggatatccgcctgggtgaggggggcccaggtccagccgggacaggcctcgtccaagcggtggatgtggttgcgcttggcgtggagttttttcccgggcaggtccgccaggcggtccacggaatagagatagtcaaacccgtcccgggcctcctcaaagcagaagcggccggggtagtggtcctccagccagtttttgtggtagagggtcagggcgatcagccgcaggggctggccctccgcccgggcgtcctgggtcagggcgtccagggcgggggtggggtccccttccccggcgggccagagataggaatggcccagggagctggtgagccggaccagcagccgtttccccaggggggcgtactgaaagccgtaggcgtctttccagcagaagagaacgggaaagctgtaatcgcacagggccagcccctcggactgtaaaaggggacggacccaggtgctgtcgctggcgtcaggggaatgaaagggtatcagcataaatgattggaaaaagcctcctcaaagggtaatggttttcacgtcgtactggttgttgcggatgatttcgtccaggcggacgtcgtcggtgacggaggagatgaggttgtaggccgcgccctggtgcttggcccggccggtccgcccaatgcggtggacatagtattccccctcttccggaatatcataattgatgaccccgtccacgtcgtcgatgtccagcccccgggcggccacatcggtggccaccaggacccggagctggccggcccggaagaaggagagcaccttttcccggaccttctggcccaggtcgccgtggatgcactgggcggcgatcccccgcatccgcagcaggccggtgatccggtcggtggtgtttttggtgttgcagaagacgatgacccggtccaggtgttcccgctccaggatggcggccagcaggtccaccttgccccccatgtccaccttcagccggtactggctgatcttgggccggttttcctggacgggccggaccacgatttccaccgggtcccgctggtagacccaggagatgtccatgacttcccgggaaatggtggcggagaacaggcccaggttccggcggtgggggatctgcttgaggatgtgggtgacatccttgataaagcccatgtccagcatccggtcggcctcgtccagcaccacggtctccaccttgtgcaggcggacggtccgacgcttcatgtggtccatgagccggccgggggtggccaccacgatctgggggcgctttttcagctgggtgatctgccggtcaatgggctggccgccgtagaggcaggccacccggatgccgggcaggaaggcgcacagctggcgcagctcctcctgaatttgtagggccagctcccgggtgggggccagcaccaggccggtgacctcggtgccctcggggtcggtgtgctccaccatggggatgccgaaggcgaaggtcttgccggacccggtgggggccttggccatgacatccttccagtccttgaagcaggggatggccccggcctgcacgggggtggccagggtaaagcccttttggtccagtgccttcagaatgccctgggagaggttcatttcactgtatcgcaggtcgacatcgacctcaatgccattgatttccataaaacaatcctttgcccgccgggcaaaggccggcgggtctcattcaaatactttaattca

SEQ ID NO: 2253 - DNA, 13003 bp, KLE1738
ccgcgggggaaagagtttctttcccccacaccccttttctctggactgttgtagaagcggcgtgggttttctgtcggcctacctggcctgcggcctccaagaccaacgcctcatggcccgcccaccagctcgggcgggcgggagaagtggtttgttgacgggaggagaaagcgggaaaccaaacggttcctctctgccttctcccaaagggtacctatccacgttcccagcccgcccagccggtgggcgggccgttacgggcctttcgctgggagggccgcaggccaggtactaagacagaagtacagcctccccctccacaaccccaccagagaagggggtcccgggggaggaacctcctcccccgggggttctttcccccatttcttcccaagaaatggggccccggctgggcaagccaaggttccctgccgttccaacggcgtaggagaaagaccacaatggcaccccacccaggcggcccccgtccccgcccgttccaacggcgccggaaaaaaccaaggcgggagacaacctttttcttccctaccagcttgatctgtgttatactatggggctgaacaaaagcaaccgcggggaggctgagcgcgtggggtatgggaattgtctggattatctccagcggcggggggtgctcccctttcgggtggcccccttctgcccggtggacgatttgatcctgtctctgtgcgcctacctcccctttgagcaggtgctccccggcccccggcagggggactgggtccccttcccccaggcggtggaggccctgacccagcggccgggctgggacgcggtggggctcatcatggccaaggacacccccgccctggtgcgccaggccgcccggagtccccggttccagaccctgggcctgggctgtgccgccggggtgctggaccagcagacccagtttgccgccctcaccttccgcctgcccgacagcaccctctacctggccttccggggcaccgacgacaccctggtggggtggaaggagtgctttgccatgagctatgccttccccgtccccgcccaggccctggcccaggactacctggtgcaggtggcccagcgccacccgggcaggctgcgggtggggggacactccaaggggggcaacctggccgtgtgggccgcccttcacgccccgccccttctccggcggcggattctgcgggtgaccagccacgacggccccggctttggccaggacctcacccgcacccgggcctacggagccctggccccccggctggtcacctatatcccccaggcctccctggtggggacccttctccaccaggacccccgggcccagatcatccagagccacggggtggggacggtgggccagcacgaccccttctcctggacggtgcgggggaccggctttgtctcactcccccgccgctcccggcggggcgaccgggagagcgccgggttccggggctgggtggacgccctgtccccggcggagcgggaggagttcacccaggtctttttcgacctgctggccgcctcccgggcggagaccctctccgagttctcccagagctgggcggacagcgccctggcggtggcgggggcctatgccgccctgcccccggcggtccggcgggatatgctggactatctgtggcggtttttggtgaatatgggcaccggggggaaggggtaggaggtcctggggccgttggaaccgctggcctgcccgggcggggggcccttgtgggtttctccctacgccgttggaacggcagggaactttggcttgcccagccggggccccatttcttgggaagaaatgggggaaagaaccccagagggaagaggttcttccctctggactcccttctctggtggggttgtgtggggggaggctgtacttcttacgggatacccggcctgcggccctcacagcgaaaggcccgtaacggcccgcccaccggctgggcgggctggggacgtgggtaggtgccctttgggaaaaggcagaaagtaaccgtttggtttcccactttctcctcccgtcaacagaccacttctcccgcccgcccgagctggtgggcgggccatgaggcgttggtcttggaggccgcaggccaggcccataccgccccaaccaccttcccccgttcctctcaccagagaatggggttccaaggggaaggaacctccttccccttggtgttctttcccctatttcttcaaagaaatagggccccgcccgggagggctccgttcccgcccgttccaacggcgtaggggaagaaccccacaacgccccccagccccccacccacgcacccctcaaaaggaggattttatggatcttatcgaaaccttcggcgccaaaatcggcgccttatcagaggaaaagccccagcgggcccggcagctgctcaccgccggtttccgggccaacggggtgaaaaacaagctggcctccaagcggagctccaagtccgaccggatgctcttccagctggtgaaccgcgccatggtcacctgcctggccaagccccagtccaacgtgatggtgagcctcttcaccccctgtgagatgctccacctccagggcctgcacccctactcctgcgaggggttctccagctacctgtccggggccatggccgagcagcccttcctccaccaggcggaggacacggggattcccaacagcctgtgctcctatcacaaggtctttatcggggccgcccagatgggtctgatgcccaagccccggttcattctctccacctccctggcctgtgacgccaacaccctgaccttccgtcacctggcccagttctacgacgtgccccacttcaacgtggacatccccttcgagtcctccccccaggcggtggactacgtggccgggcagctgcggcagatgggagaattcctcacccagcagacaggcctccccctggacgacggccagctggcccgcaccgtggcccgcagtcagcggaccatggccctgtaccaccggggcctccgcctccgggcggggcggcaggtgctcagcgacctgaccagcgagctgctccgcaccgccgccttccacttcctcctgggcaccccggagaccgaggcctatgcccggcagctgctccgggagatcaccaccgctccccccgcccagggcaagcagctgctctggattcacaccaccccctactgggtggcccccctgcggcacctgttcgcccagagcacccgggtccaggtggccgcctgcgacatgagctatgaggggattgtggaggccgaccccacaaagccctatgaggccatggcccgccgcctggtctactcccccttcaacggcccggcccagcggcggatcgaccgggccctggagatggccaaaaccgtgggggccgacggggcggtttggttctgccactggggctgcaagcacaccctgggcggcgcccggctgggcaagaaggccctggaggaggccggcctgcccaccctgctactggacggggacagctgtgaccggggcttcggcggcgagggacaggccgccacccggatggaagcctttttggaagtattggagggcatggcatgagcatcacctatcacgtctgtaaatacacccccaccgagctcctcaccgccctggggggccagtgcgccctgctggacgaggccccggagaactttgacctgtccgaccaggtggcccaccccaacctgtgcggcttcggcaagtcggtgatccaggcggccctggccgggcaggtgaaggagctggtgctggtcaactgttgcgacaccatccgcagcgcctacgacatcctcaaggaattcggcaacctggactttctctacctgctggacatcctccacagccaggagggatgttccgtccagcacgcccgggaccagctcctggccctggcggaggcctacggggcctacaagggcacccagttcgaccgggcggctttcttcgccgccttccagtcccctcccccggtcaccgggccccacatcgccgtgctgggggccaagatggggtcccacctcttctccctggtggaggagaccatgcccctgccggtggaaaacgccacctgcgccaacaaccggcgggtggccccgccggcggaccagggggacttcgccgccctcatggaggactacgcccgctgtctgctgggccagctgccctgcatgcgcatgaccgacaacaccgcccgccgggccctgtacaacacccccggcctggagggggtggtctaccacaccctgcaattctgcgactactacggctttgaatacgcgggcctgcggcaccagctgccggtccccctgctgaaaatcgagtccgacggcaccacccagagccgggagcagctgcgcacccggctggaagccttcgccgagggcttcggcccccagaaaggagaccccaccatgaagaaacacggctatttcgccggcatcgacagcggctcggccaccaccgacgtggtcatcctggaccaggaccggaccatcgtggccaaggtcatcctccccaccggggcgggggcctccaacggggcccagcgtgccctggaccaggccctccagcaggcgggcctcacccaggccgacctcaccgccacggtcaccaccggctacggccggggggtcatccagacgggggacaagtcggtcacggagatcacctgccacgccaagggggcccactttctccaccccgcggtgcgcaccgtcatcgacatcggcggccaggacagcaaggtcatccgcatcgagcccgacggcagcgtggccaacttcgtcatgaacgacaagtgcgccgccggcaccggacgctttttagagatgatggcccggaccctggagctctccctggaagagatctccaccatcggcctgcagtggaaggaggagatcaccatctcctccatgtgcaccgtcttcgccgactcggaggtggtctccctggtggcccagaacaaggccctgcccgacatcgtccacggcctgaaccagtcggtggccacccgggccgccgccctcttccgccgggtggggggggagaacccctgcatgatgaccggcggggtctcccggaaccggggggtggtggccgccatcgaggaaagattggggcagccgctgttcatccatcccgacgcccagctgtgcggggcgctgggggcggcgctgtttgcgctggagatgccctgacagggggttttctgttcctttctttcgccgttggaacggcagggaaccttggcttcccagccggggccctatttcttggaagaaataggggaaagaacccccgggggaggaggttcctcccccgggacccccttctctggtgggtgtgtgtggggggaggctgtacttctgacgggatacctggcctgcggccctcacaatggaaggcccgtaacggcccgcccaccggctgggcgggctgaggacgtgggtagggaccctttgggaaaaggagaagaaaaaccgtttcgtttcccactttttcctcccgtcaaggaaccacttctcccgcccgcccgagctggtgggcgggccatgaggcgttggttttagaggccgcaggccaggtagaccgatcgaagaaccacgccacttctacaacaggccagagaaaaggggtgtgggggaaagaaactctttcccccacgggggtccagggggcaaagccccttggtgctctttcccccatttctccagagaaatggggccccgcccgggagggcaccgttcccgcccgttccaacggcgccggggaaagcccacaacggcccccacctgggaagccctcgttcccgccctttccaacagcgccgggaaaagcctctcccacccccctctcccccaaaagagggggctttttttctcccctttttgggcactttcacacccgccgttgacttcccttccggtttctggtacaatggctaacatagttagtgatcgtgggagtgtcaatggatatgatggcaaattatgaaggcttagccacagaattgctccaggtcaatgaggacctcctccgggtgcccgcccggcacctgatttccaagctcacccagggggagcacttcgtgctgaactatcttctcacccaccgccaccaggcccacccggtggacctgagccgggggctggtggtcagcaccgcccggatcgccgcccttctcaaccgcatggaggacaagggcctgatctcccgcctccccgaccccctgaacaaccgtcaggtgatcgtcaccctctccccccaggggctggaggccattcaaacctttcgttcccaggtgattcgctccgccgcccagatgctggcggacctgggcccggaggatgcccgggaattcatccgcatccagaaaaagcttctggccaaccagcggcccaccggctaacttgacccatattggattaccgaggtgaacccaaatgacagatcgaaaccaagggggcgccctacgcaccttctccccggagcaggcggacaagctcttccacagcccggcgctgcggcacctgttccaggaaaatgcctctgatgaatatgccctgatctggctgctctccaagcataccaaggacaccggcagcgagaagatttacctcaaggacatcgtccgggagctgaacctgcccatgcccaaggtctccgccatcgcccgctccctccagaacaagggcctggtccgctggacccacgacggcaacggggaggaggggacctatatcctgctcacggacaccgccgtgacctccgtccaggcccaccgtcagacccttcgcgcctaccaccagcgggtggtggccgcctatggagaggagaaattcctccacctgctgggggagatcgcccagctggaggagattatgcggcaggaagccgagaaagtgggaggtgcccatgaccaagcgtaatgtggaggcctacgccgccgcccaacagcccctgtgcgtccagaacgacaccatccccgaatccctgttccaggagtacggggtcaaccggggcctgcgggacgccaatggcgtgggggtcctcacgggcctgaccaacatctccaaaatcgtctccttccagaacgtggggggcaagcgcatgccctgcgaggggcagctgtggtaccgggggtacaacatcaaggacctcatcggcggcctggggccccaggagttcggctttgagaaaatcgcctacctgctggtcttcggccagatgcccaccccggaggagctggcggagttcaccgccgtcctggccgactgccggaccctgcccaccaacttcacccgggacgtgatcatgaaggccccctcccgggacatcatgaactccatgacccggagcgtgctcaccctggccaactacgacgaccaggtcaacggcggcctgggcaactccatccggcaatgtatccggttgatctcggagtttcccatgctggcggtgtacgcctaccacgcctacaaccactatgagaacaacgacagcatgtacatccaccggccggaccccagcctgtccaccgcggagaatatcctgcggatgctccgccacgacatgtcctacacccagctggaggccaaggccctggacatcgccctcatcctccacatggagcacgggggcggcaacaactccaccttcaccacccgggtggtgacctcctcgggttcggacacttactccaccatggccgccgccctgtcctccctgaaggggccccgtcacggcggcgccaacatcaaggtcatcgagatgatccaggacatcaagggccacctgtccgactggaccgacccggaggagaccagccattacctgcggaaaatcctcaataaggagacctttgaccacagcggcctcatctacggcatgggccacgcggtctactccatctccgacccccgggagcagattctccgctccttcgtcaaccagctggccctggagaagggccgccaggacgacctggccctctaccggaacattgaggtggaggcccccaagcttatctccaacaaccggcccatcttcaagggggtcagccccaacatcgacctgtacagcgggttcctctatgacctgctgggcatccccatggagctctacacccccctgttcgccatcgcccggatcgtgggctggagcgcccaccggatcgaggagctggtgtgcatgaacaagatcatccgccccgcctacatgagcgtcatgcgggagcggggataagaagattccgccgggttcgacgatccgtttgggaaccatcgggacacaagatgctgcaaagattgtgcaaatatccccagatgcctgaaacgattctccgaaaggtgatgtaacatgacggaaaaagaaatgctggaactcatgaagcaagcccttgaacctgtccatgaaaaattgacggttctggatacaaagatgacttccctggatgaaaaggtgaattctctggatgccaaggtgacttccctggatgaaaaggtgaattctctggatactaaggtagcctccttggatgctaaggtgaattccctggatactaaggtggcctccttggacgctaaggtgaattccttggatgccgacgtgcgcgggatcaaagtcgtcttagagaacgaagtccgccgtgacctgaaccttctggcggagggccacgctgccattttggagcggctgccctcccaggaggagaaggaagccttggaagcgcggatggacgccatggaggcggccatccgcctgcacagcaagcagattcgagagttgaaaaaagcgcaatgaggcgtccggaccggcagagcaccccggacgcccccggcggcgcttgcgcgccgggaccccgatcgtttggacaaaaacagacaggcggagaccgcacccgatagcggtctccgcctgttgctccttttctccagttacagtccctggcagcgccatgtctccagcaaggtccgggtcacctccttggcaatccaggcggctttgtcacagttctgctcaaagcacgccgcgccccgctgatcggcggtgtctgtaagggtccgaaccgccagaaaagggacctgattgacgtagcagacatgggcaacggcggccgtctccatatccacggaaagcgggtgccaggcggcccggatcgcctcccgtccgccctcgtccgccaggaaggtctcccctgtgaccatccgtccaaacaccacagggtgctccccccgggcggccgcctggcgggccagggccagcagcctcgcatccgacgggaacacgggggccggcagccaggggtgaaactccgtcaaaatctccgggctgacatcgtggtatccggcctccgtggcgatcaccgtgtcaaatatcgaaaggcccggcgccagggcgccggcggtccccacgttgaggaccgccccggcctgatagctgtcaatgagaatctgggtggccaaggccgcgttgaccttgcagaccccgctgaacagcgtgaccacatccacgccgtggaaggtcccctcatagaagcggagcatggcctttcgggtctccgtgaccccttccatgtccgccagaaagggcgctgcctcactgtcgctcgggcacaaaatcccaattttttgcttcatttcctcggctcctttcctactctctttcccggtctgtcccacgccccgccggtgtcaccaggctgtgggccatccatcgtccgctgcggtaataccacaggagcaccccgctgcacaccacccagcccaccggatagcccagggccaccggcagcagggtcccggccacctggtaggtgacaaagagatagagctgccggaagaccacaaaggaccccagcatgatcaccatgggcaccttggcgtcccccgccccccgcagggccccggcgtaaatctgattgaagttggccaccagatagaagggggagatcaggcggataaaatacaccccgtaccccagcacctccggctcctggttgaacagggtgcacaggggctgggcaaagaccatcagcgggaccaaaaggacccccgtcaccaccgtggccatggccagggcacagcgaatcccctgcttggcccggtcccagttccccgcccccacgttctggcccacaaaggtggtggccgtcaccgacagcgtggtcatgggcaggatgacgaaggcgtcgatcttctgataggccgcccacccggccatgcaggaggaggcgaagcggttgacataggactgcacaaacacattggagaaggaggtgatggccagctgcagggccgagggcacccccaccacgaagatgttccgaagaatcccccggtgcatccgcatcccccgccactggatgcggtagcatccccgggaccgggtgagtacccccagcaccagccctgccgacaggacctgggccgccaccgtggcaatggccgccccggcgatgccccagtggaacaccgccacaaacagcaggtccagcccggtgttcacccccgccgagaagaggagaaagtacagcggccgccgggcatcccccaccgcccggaggatgcccgcccccaggttgtagagcatcagccccgacaccccggcgaagtagatccggaggtaccgggccgcctggggaaacacatccgccggcgtggccatgagccggagcatgccggggaccatggcaatccccaccgccgtgaataccccgcacagcagcagcaccagcagcaggctggtctggaccgcctggcccaccttctcctcctccttggccccatagaactgggagatcaccaccccaatccccgccgacagccccagaaacaggccgatgagggtgttgatgatgggggtggtggtccccactgccgccagggcggccttgcccacaaaattgcccagcacgatgctgtccacggtgttgtagcactgctgaaaaaaattccccgccagcagaggcagggagaagagaagcagggcacggaaaatgccgccctgggtcatgtcccggtccgccgtttttgtcctggccatctgccgccgcctcctttccgcccggttggaatgcctccattatagcaccctctttccccctgtcaaccggccccggggttggccttttgggggttttttgctataatgaagaaaataaccacgaacccccaagaggtgaaccaccatgaaacaactcgtcatcggcattctggcccacgtggacgcggggaaaaccaccctgtccgaggccctgctctacaccgccggggccatccccgccctgggacgggtggaccaccgggacgcctatctggacacccacgccctggagcgggaccggggcatcaccatcttctccaagcaggccctgtttcagaccccggcgctggcggtcaccctcctggacacccccggccatgtggacttctccgccgagatggagcgcaccctccaggtgctggactacgccatcctggtcatcagcgccaccgacggggtccaggcccatacggagaccctgtggcggctgctccggcgcaaccagatccccaccttcctctttgtcaccaagatggacctgcccaaccccggccgggaggctatcctggccgggctccagcggcagctggacgaggggtgtgccgacttcacccgccgggacggggcctgggccgagggggtggccctccgggacgaggggctgctggaccggtacctggagactggccgcctgaccccccgggacgtgtcggggctggtccgcctgggccggctcttcccctgctacttcggcgcggccctccggctggagggggtggcggactttctccagggcctgacagactacaccgaggccccggtctatcccccggacttcgccgcccgggtctttaagatcgcccgggacagccagggcaaccgcctgacctacgccaagctcaccgggggcacccttgccgtccgggcccccctgtcctacctcccccaaacgggcggggaggtgctggaggaaaaggtcacccagctgcgcctgtactccggggccaagtaccagaccgcggaggcggtttccgccggccaggtgtgcgccctgctggggctcacccagacctaccccggccagggcctgggggccgagccccccgcgccgccccccctgctggagccggtggtcacctaccgcctggtcctccccccggactgtccagcccaggtcctgctgcccaagctccggcagctggaggaggaggacccccagctccacctggtctgggacgagcacagccaggagatccacgcccgcctcatgggccaggtgcagatcgaggtcctccagcgcctgatcgccgaccgctttgacgtggcggtccaggtggacgccgggcgcattctgtacaaggagaccatcgccgccccggtggagggggtgggccactttgagcccctgcgccactacgccgaggtccatctcctcctggagcccctgccccagggcagcggtctggtctttgacagccggtgcagcgaggacctgctggaccggaactggcagcggctcatcctcacccacctggccgagcggacccaccggggggtcctcaccggcgcccccatcaccgacctgcgcatcaccctcctctccggccgggcccaccccaagcacaccgaggggggcgacttccgccaggccacttaccgggcggtgcgccagggcctcatgcaggccgagagcgtgctgctggagccctggtacgccttcaccctcaccctccccgccgagcagctgggccgggccatcagcgacctgcaaaccatggcggggaccttcgaccccccggagagcgacgggacctgggccaccctcaccggcaccgccccggtggccgccatgaaggactatcccctgaccgtggccgcctacacccggggccgggggaaattcgcctg

SEQ ID NO: 2254 - DNA, 12216 bp, KLE1738
cgcacagttaaaaacagagtatgccgaactgtctccgcagcacaagccactccgggaggaagtcatacggctacggcaggtgcagaacgccgtagataccgcactgcgccggagggagcagccacaggcagtacagagaaagaaacatgagatggagctatgatataaccggcagctttaccgctaccagtatttttatggagggagcatttgaatgtatttgaagcggtgaaacagtctgttaccacccggcaggctgcttcattctatggaatccgggtggggagaaacggcatggtctgctgtccattccacaatgaccgcacgcccagcatgaaagtggacagccgcttttactgcttcggctgcggggcttccggggatgtgatcgactttgccgctttgctgcatggattggggaaacgggaagctgcggtcaggcttgcggaggacttcggcgtttcctatgagaaatccggcaatgcgccgccagataggaagcgtcacaacaggtcacagccccgacaaaaatcagcggagcagagatttcaggaaacggaacggtattgtttccgggtgctatgcgattatctgcgcctgctggagcattggaaaacagcacacgccccacagccgcaggatgccatctggcatcctctttttgtggaagcgttgcagaggataagctacacagaataccttttggatattttgttatacggagaaatagaagaaaaagcggcattgatcgccgcacagggaaaggaggtgttgcggcttgaacagcgaatttcagagcttgccgccggaaacgcaggaagcggtcaaaaggacgatggacacaatggaaccggcgcagacaccggcagaaatccgggaaacattagaggggacgcagaaaggcggcgtgaagaacagcatccgaaactgcctgacggtgttccagcgtgaccctctgtttcgcggggcgctgcgcctgaaccttttgacggagcagattgacattgtgaagccgctgggctgggagcgcaccagtaccacgctgaccgacatggacatgaactacctgcttttgtatctggaagaaaattacgggcttaccagcgagaaaaaggtgcagagcgccatcaagattgttgccaatgaaaaccgctaccatccagtcagggattacctgaacagcctgcaatgggacggcacagagcgcatccgttacgccctgcatcactttctgggagccgatacggacgaatacacctatgaagccttgaaactgttcctgatgggagccatccggcgggtattcagaccggggagcaagtttgaggtcatgctctgtctggttggtggtcagggagccgggaaatctacctttttccggctgctggcaggcagggacgaatggttttcagacgatttgaaaaagctggacgatgaaaatgtgtaccgcaagctgcaagggcattggattatcgagatgtcggagatgattgccacagccaacgccaagagtattgaggaaatcaagtcattcttaagccgccagaaagaaacctacaaagtgccgtatgagacacatccggcagaccggctgcggcaatgtgtatttggagggacgaccaaccggcaggactttttgccccgtgaccgcaccggcaaccggcgctttctccccgtgacggtgtacccggaacgggcggaggttcacatactggacgatgaagcggcggcgagggcgtatatcgaacagatgtgggcggaagccatgacggtttatcgcagtgggaagtataagctgtcattcagcatggaaatgaaccgatacctgaacgcccaccagcaggactttatgcaggaagacacacaggccggcatgatctacgcctatttggaggactacaccggcgacagggtatgttccaagcagctttatgaggaagcgctggggaacttaaattccccggcagactgggagacacgggcaatctgcgagattatgaataccggcattgcgggcggcatcatacagggctgggtagcctacaaaagcccgaagcggtataagaaatacggttctcaaaaaggctgggagcgtgtcaaccaagctccgccggagggggacggttttcaggaaatcacggaagaagaagcccggcaaatggaacttccattctgaaaagccaccggttgacagtttggttgacgctttggttgacagccggttgacggggaaaagcctgatatttggggcatttctctcctttgtcaaccatgtcaaccaagaaatcaaagaaaaagtaaaaagtaataatagagcgcctatggattgttttcaaagtcttttctgccggttgacacggtttggttgacacggagacagtctgcggctgtacacctgtctgacattcccttgtcgggcatatttcatttatggaggtaactgcctatggcaaaaagcaaaaacgagagcaataacaaaaacagcggcaccctgcttaccgaaaaagacggcacccagtattttgtcatggggaaagtccgtatcaaggtatcggagcatttcgcacaggatgggaagccgcttgacagcctgctggaagatgtgatccagcacgctgccgccgcttcctgaaaaaatacggaataacgactgtcaatcagcccacgcttatgatatacttgtaccagcgagtattgtataagcgtgggttgtttcttttagaaggaggatttttaaccgtgaaacaaccatacaatacaacgatttataacactgcactatatttgagattgagccgtgacgatgaattacagggggaaagcggcagtatccagacccagcgcatgatgcttagacagtatgccgcagagcatgggctgaccgttgtagacgagtacattgacgacggatggagtgggacaaatttcgagcgtccaagtttccaaaggatgattgatgacatcgaagacgggaaaatcaactgcgttgtcacaaaggacttatcccgtctgggaagaaactatatcctgaccggtcagtacacggaaatctatttccccagcaagggagtacgctacattgccatcaatgacaatgtggacaccatcaacggagaaagcgagcttgcaccgttcttaaacatcctgaatgaaatgcacgcccgacagaccagcaaaaaggtcaaggctgccatgcacacaagatttgccaatggcgcacactatggagcctatgcaccgctgggctatgtaaaagacccggacaaaaaaggtcatcttctgatcgacccggaaacacgctggattgtagagaagatttttgaccttgctgtacacgggcgtggagccgccagcattacacggattctggtggaggaaaaagtacctacccccggctggctgaactatgaaagatacgggactttcgccaatatctacgccggtgcgcccgcagaaaaagcctatgcgtggacgatagcacaggtcaagagcattttgaaagaggaaacctacatcggtcacagcattcacaacaagcagagcaacatttcattcaagaacaagaaaaaggtgcggaagccgcaggaagaatggtatcgtgtggaaaatacccacgaagccatcatttctgaagaagtgttccaaaaagttcaggagctgattgcaagcagacgcaggaaacgcagaaacggtacgacacagattttcgcaggattgataaaatgtgcagactgcggatggtctttagcctatggggaaaacaagcagaataagaacccatacgggtactaccattgcagcaagaacgggcagggattacgccagtgttccatgcactatatccgctatgatgtactgtatgcctatgtgcttgcaagactgcaatactggtctatgctggcacagaaagacgaggacaagctgctgaaacgcctgctcaatgccagcgacagggaaagaaactctgcgaagaaaaagcaggctgcggagctgaaaaaggcagagaagcgtaaagccgaggttgacgggctgtttgctaaaatgtatgaggactggtctgccggacgcataaccgagtataacttcaatatgctgtccgagaagtaccagaacgagcaaaaggagcttgaaacaaaaataagacagcttcacgaaacgatggaagccgccgtacagaccgcagcggatgctgaaaagtggattgccctgatgaaacagtatgtcaaccctgtggagctgaccgccgaacttctgaacactctaattgaaaaaataaccgtccacgaagctgtcaagggcgaggacggaagccgtgagcaggaagtagaaatctactaccgcttcatcggcaaaatcgactgacttttcttttttacccaacaatatctttaattaagggagacgggggagagctttcccgagatcacccttctgcccgccctggcccggctgctggggacggacctgaacgggctgttgtcctttcagcaggagatgggccgggaggagatcgcggcctttctgggccgcctggtgcaggcggcggaggaggggcctcaggcggcctttgccctggcccgggcccaggtggggcagtttccccgctgcgacagcctggccctcaacgtggccctgaccctggagggggtgctgaccatggcgggccgggagggatcggcggaggagagggaatggatacaggccctctaccgccaggcggcggagagccgggaccaggcggtggcctgccaggcccaggccatgctctttggccgggccatggaggagggagactttgcccaggcggaggctctgctggaccggctgcccccccagcccctgtacgaccgggcccagatggaggcccgcctggcccaggccaagggggatggggaccgggcgggacagctgctggagcaccagctgctccaacaggccagcggggcccagaccaccctgctggccctgctggagctggccggccgggagggccgccggggggatctggcccctctggcggacaaggccgtggccctgggccagctgctggagctcgccccctacggcggctggtcggtccgcctccagcaggcctgtctgacccgggacacggacgcggccctggcggcgctggcggggctgctggggtctttggagaccccctggcccgggggaacctcccccctctgccgccacctgccccggaaggacggggcggtgctgggggccaagctgcggccgggcatcctccgggagctcgccgaccctgacaaccccacctatgccttcctccggtccgacccccggttttgggacctggtgggggaggcccccgccgccccctgaaaaagccgcccccgcctgggtcccaggcgggggcggctgctcttagaagtagtcggagatgtagggggtctgctgctcgatggcgtcctccagcatgtcgatggtggcctcgctggtgggcaggcggccgatcttggccaggtagtccggccgtttgtagcccatgagcatggtggtcatggtctggatgctcaccctgtccgggcagggacctgggatgggcacggcccgcccccgcccggcctgggagatggtcagccggaagctcccctggttccagggcagcagggggtcggtgagggtgaaggaccagctccggtccaccgcgtcgggcttgaaggggtaggcggcgatgaactggggaaagtccacgatccgccccatgtagtagggggagatggtctcggtgatgctggcgtcctccaggaggaaggccaggggctcatcggtgtaggtgctcccctccacccgggtgatcatggagaagtgggccgagacgaagttccacagccccgcccgggcggtctcgttgttgaagatcatgtccttgatgtgaaagacctcgttggcgatccagtagatgacgtatccgtcgggctggtcctgctcgttgtagtagatggccgccatgatgtcgtccgggtcccagagccagtactcattccaggccagctcgtcccggagcaccgccccgtgggtgtgctgggcaaagcgggcgtaggtctggttgagggcctcgctgtcggttttcacccgccggacgtagccgggcacctggcgggccttggggagctggaagtcctggatcacgtaggaaattttgtcggacaccacctcccaccccttccgccggtagtaggggatggagtaggggtagaggtaggagagatactgcccccgggcccgcatgttggtcagggcctgctccagcagcttgtgcatcagccccaggttggaatactccgggtaagttcccaccccggtcaggccgcccatggcgtaggttctgccaaaaatgcgcgcctgcatggggtagaccgccacctgggagaccagggtgtcccggtcaaaccagccgatcacgtcggccttttccatggtggggaacttggcgcggatgaattccttctcctgccagcccacggagctgagttcctggtcggtgacctggaagacgtagcgcagcagagcattgtactgctccaggtagcggctgctgacgggctgcatgtgtaactgtttttggttcatccgttccatcctttctttggcctactgggaaaggccattctttattgtagcagatttccgggcgtttggcaatttcaggcagaggaggaatcgggtcggaagaggggagcggggggaaaatttccccgggaagaattgcaatgggggcccaaagtccgtataataaccagagagaaaacggggaaccctgtccccagactggattgaaggaggccgtcccattgcacgagattcctgccctgatcattgacctgaccatcatcctggtgatcgccgccggaaccaccctgctgtgtaagaaaatccacctcccctcggtgctggggtacatcctggccgggtttttggccgggccggtggtggattttctgcccaccatccaggaccggggcggcattgaggtctggtcggacatcggggtgatcttcctcatgttcggcctggggctggagttctccctgcacaagctggcggaggtggggggtccggggcttttatccgccggcatccaggcggcgggcatggggggcgtgggggtcctgctgggcctggccctgggctggggccccatgaacagcctctttctgggggtcatgctggccatgtcctccaccatgattaccatgaagaacgtggaagatttggggatgaaggaggagaagtttgccggcctggccatgggcaccctggtcattgaggacctgcttgccatcttcgccatggtggtcctgtccaccatcgccgtctcccagtccatcagcggctgggccctggcccagcggatcggcctgctggtcctctccctggccctgtggctgattctggggatttacctggtgcccaccctgatgaaaaagctggtggggctgatgaacgacgaggtgctgctggtcttctccctggggctgtgcttcctcatggccctgctggcccaggagatcggcctgtccacggagctgggggcctttctggccggctccctgctggcgggcacggtccatgccgagcgggtggagcatttggtgaccccctgcaagcatctcttcggggcggtctttttcgtctccgtgggctttatggtccagccggccatgatcgcccagtatatcgggcccattctgctgctctcgggggcggccattatcggcaagctcctcttcctcaccctggggggcctggcggcggggcagcccctgggggtctgcctgcctgcggcggcggcccagacccaggtgggggagttctccttcattctggccggcctggggcagtccctgtcggtgacgggggccttcctctacccggtgattgtggccgtgtcggtgatcaccaccttcaccaccccctttctgctgcggctggccggtcccctccagcgggggctggagcgggttctgccccaacggtgcctggcggcgctggaccggtactgtcaggcccggggacgggagaagggggaggaaggccgggactggacccggttcctccagggatatggcagggcctttgccctgtacggggtcctggccgtgggggtcatcctcctggggacccagcagctgctgcccctgctgggggactggctggcgccccggtggtggctggcggagctgctgaccgcgggggtcatttacctggccctggccttcctcctgccggctatgctgcggatgaagaagcggtattttacagccctgtggctggagaaggtctccaaccgggtgatcctgtcggggctcatggccctccgcctgggggcggcggccctgctggcggcggccccggcggtgatcctcttccaggccagccccctgtggatgtcggtggcggccctgccggtgatctggatggccacccactcggaccggctggccgggcgctacctggaggtggaggcccggttcctggccaacttcaacgagcggaagctggcccagcgctttggccagggggaggaggaggtccacctgtggctgacccagcagctctatgtgatccccctggtctgccccccggactgggcccaggggggaaagaccctccacgacctggactggggcaggcgggaccacgtgagcgtcctgaaggtccgccggggccagacccactggaacatccccgaggggaacgtggccttggcagggggggaccagctggtggtcatggggagccagcggcaggtggagaacttctgcctccagcgggccgaggagggccttacgccggcgggggagctaatgaccctcaaggactacatcgcctcccagcaggatatccccgaggccaagcagctgctgtgctgcggggtgagcctggacaaaaccatgccccaggcggggaagagcgtccgggacagcggcatcaaaggggactggagcgccctgctcatcggcctggagcgggacctgctgcccatccccagccccgaccccagtctgaccctccgggacggggacctgctgtgggtgatgggctcccaggagatggccggcaagctgctgcgcctgggcctgctggactgaagaaaagacccaaaatcgggacaccccccagccggtacgaaagtacggactggggggtgtctttttgtgcacaattttttgggggaaaggtgtacgccgacgtccccctttggacggggtttcccccagggtgagaggaggaatgtctatgaaagactatccatatcccatgcaggcccggaacgaagccctgtgtcccttcacccgggacacccagctcagcggctttctcaccctgcccaagagcctgctctgctgggggctctccccgggggcgctgctggtgtacggcttgctgctggaccggggaaagctctcccagcggtcgggctggacggacaagcaggggtgggtgtacgtgatcttcccggtgcgggagctggccctggccctggggaagggggtcaccaccatcaagcggtggctgcgggagctggaggagcgggagctgatcttccgcaccgtccccttccagggggaggccgggtggatcttcctgcgggtgccccggtgcggggtggagggggagcgggagaaggccctgggcctgccgccccccgcccccgctgtccgggacccctgggaggagcgggcctgggcgccccgggagggcgggctggaccccaccgacgacgttggccggatgctggcggcgctggagcggagcggcgggcagttttccacagccccgtccggttccggccccgggtcgtctccgggcacccccggtccaattccggacgggggaggggccggatttgggccataagtaaaataattagtcaatctaagagtcaatccaatcctattatgggcggcggggggaaggggcgttttccaccgccttggtttgggtgggggcgctggggtttttccccggcgccgttggaacggcggggaacgggggcctgcccggccggggccccatttcttgggaagaaatgggggaaagaacccccgggggaggaggttcctcccccgggacccccttctctggtggggttgtgtggggggaggctgtacgtctcactggttacctggcctgcggccctcacagtgaaaggtccgtaacggcccgcccaccggctgggcgggctggagacgtgggtgggtaccctttgggagaaggcagaaagtaaccgtttggtttcccgctttttcctcccgtcaacaaaccacttctcccgcccgcccgagctggtgggcgggccatgaggcgttggtctttgaggccgcaggccaggtaggccgacagaaaactcacgccgcttctacaacagtccagagaaaaggggtgtgggggaaagaaactctttcccccgcggggtccaggggcacggcccctggtgctctttcccccatttctccagagaaatggggccccggctgggaagccaaagttccccgccgttccaacggcgtcgggagaaacccacaatagcccccgcccgggagggcaccgtcaacggcgatgggaaagcctcagcccctcacacccgccgcagcccatccatcagcggcaccagcagcgcatggggaatcaccttcgcccccagccggtgcagggtgcagacaatccccggcgtggccacccacaggttcagggcgctggcggccagggagagggagaccaccgaccggctccgggaggccaggggaaagtggcggaactgcccaggcttgccatcctgggccagggggatgaactcggtgtccttcacccagtaggggcagacagcggtgacgtgaatcccccgggggaggagctcgtagtggagggttttcgtatagctctggagaaaggccttggtggccgcgtagacccccaggccgggcatgggctggaaggcggcggtggagcacagctccagcacccggctgccccgggtgaggtagggcaggcacagctgggtcacccccacggcggcccggcagttgaggtcgatcatccccaagctgtccgccggggagaccgcgtcgatccggcccattttgcccacgccggcggcgcacaccagccgggtgacggtgggcttctcccgggccagcaggtcccggagggcatccagggactgggggtcggtcaggtccagggggaccgggcgcaccgggcaggcgcacagggacgccagctggcgcagccggtcctcccgccgggcgacggcccagaccgcctgaacgtgggggtcccggctgacctggcgggcgaattcccggcccaggccgctggaggccccggtgatgagggcaatgttcatacagcccacctccttctttggggtagtatggccgggacaggggtcaggaatccctgctcagccggcctttttggttcagggtttggaggacctggtcgatctgccggcccacccactccacctcccgccacagctcgtcggcggacaggcgcaggacccccgcccggagggcggagagctggatgaggccgtcggaggtggccacccggacggtgtagtttctgccgatctcctggaggagcttttcgatgaacatgtcccctgtctcgtcctgcttggtgtagaccacgtggatgtggtggtagtcgaaggtggtcccggggttccccttcaccttgtacccgtcaaagaccagcaccaggcggcactgcttgtagccctggtagttgctgagaatgtccatgagccgctggcgggccgcgtccaggttctcccgggccaggtccttcagggcgtcccaggcgaagatcatgttgtaaccgtccacgatgagatactgctgcttggggggcgcgatggtccgccggggagcggcgggggcggcctgacccaggaactggtactcccggcggcgctgggggccgaaggtccgcaggaagatggcctccagctccttctcgtccaggtccaggttccgggtgtacacccgggggaccggggcggggtcctccccccgctgctttggcagggcgctctccaggtgcatgtactgggggacctggtcccacttcaccgaaaagcccccgccgtgggcgcagaagaccgagtcgggggtgtgctccaggtcgccctccgggtcatacccggcggcggccaccacctgcttctggttgtggcag

SEQ ID NO: 2255 - DNA, 19901 bp, KLE1738
atcggcgggtacgaggatggttcttatcatcctgagcgcaacattaagcggtctgagatcaccaagatgatctgtgtggccctcaacggcggcaaagagccgaatctggctacccccggtacccccaccttttctgacgtgcgcggcaccaccgctgcctgggcagagaagtacattgagtcctgtgtgtcccagggcatcgtgtccggtgtgggcggcggccggttcagccccgctggcaacgtgaccgcctcccagctggccaagatgctgctggtttgcctgggctatgacgcagacattgaggagtttaccggcaatgcttgggacaccaatgtaaacgtggttgccacccagaaaggcatctacgaagggctgtccggtctggatgtctccgccgcactgacccgcgacaacgcggcccagatggtgtggaacgcactccaggccaccgaggtcacttataagtacactctggtcagcgagaacggccagctggtctccaaggtggagctggtcgacaagactggcgaaaagggcaacaagatcaccctgctggaagacaagtacagcggcgccggcatctacgaaggcatcctgactggcgccggcgaactgggcaccgccggcaaagacaagattggaatgcttgttgttgacaagctcaacggcgccacagtggatgacacgaaggatcagatctggacctactccgacgatgtgaccaacctgtacatgcagtatgtcaaagtcctggtcaacaacaagggcgacgcttacggcgtgttccccgtggccaaggaaaatactgtggtcaccgacatctttgccaacgtgaagcaggatggtgacaagattaaaattggcggaacttcttataactatgacgtcaacaaaacatctggcaaagaatccggcatggtatatggcgtgaaaaattcttctggtggccccctgtacatcaacgaaatcgcggccgaagtccgctccggcgatcagatcaccttcatctccaacgacggcgacaacaagttcgatctggccattgtgaatcccatgaccagcttcggcaaggtcacctatgtggactctgaaaaggtcaacgtcaccggcgtgcccggcgccttcgaggaggacgacatcatccctgacggcctggtcaagggcgactacgttgccgtatacaaggattcgttcactggcaacgacaagctggtgaaggctgaaaaggtgaccggcaaggtggatgccaccaagggtaatggcagcacgattactgacgtggagattgatggcaactggtataccttgggcaataagaatgccaacgagcccttccagaatgctgtcgttgccaagggtgactccgttaacgggaccggtgatactctgaccctctatgtgatcaacggagtggcttaccaggtcacaaaggaggccggtggctccaccgacacagcgtttgtgatccgtaagaccaacagcatcgacgcggacggcaatgtccagatgcgcgtcctgttcgcggacggttccgagaagaccattgccgcgaaagatacctctgcgcttagcagcatcaacaacggcgatttggttacctacgagatggaaggctctgcttatgagctgaccaaggtcgcagacggaacaaacgaggccggcggcgattctgttgtgagcgatacttccaatggcaagtttgtcaaagctgataaaaagatcactgtcggcggcaaatcctaccgtgtatccagtgacgctgtggtctacatccagtatcaggagaccggctccaacgatgtgaagtaccgtgcaatgactggcgcagagctgaataatctgggcggcgacttcacagcagataagggttgcatcgccgttatcgatgatggcttggcttccgtggttgtgctgaagagctccgcatacctgccgggcgcaaacgcggataagatgtacggctacgtgaccgatgctggcaccacccgcgaggacagcaacggcaagtaccgtgagttcaccgtttggaccagcagcaacgaggagcaggttgtgaagatgaaggcgaccggtacaagcatcgtgaagggcgatctgatctccttcgacatgacgtccgacaacttcattgagggcgttctgtctacctctgacggtacgaacaaactgacggttgctaccggcgcgattgaccagttcggcaaggactacatggttctgtttaacggcgaagacctgaccttcgacgatgacgtgaagtacatctacgtcaacggggaagaaggcgtggccggcgacggtctggaacaggcgtatgagaccgctgatggcaatcgttacaacaacgtgaagtatgttgttgattcttccaccggcgacgtggttatggttgctctgaacaccgctgctgacggctgggataacagtgtaacggttccgagcaaggacgttgccaatgttgttggaaacgttgctactggtgccaaggcaactgtatctgttaagggcactacaactaccattaacctggctggtgaagtgactaaaggcgttcctgctgctctgaacaatgtgtttactggcaaggaaggcaacgatactgatctgactgccgttaccctgaaaggcattatcccagagagcggtagtgtgaccatcacgcagaagaacgatgcactgaaggtgtactattcgacttccttctctgatggcgagaagatcgggacctacgatcgtgtgaacagtaatggcggcgagacgaatggcgattattcgctcctgattcaagaaggtaagaccgctactgtaacggtttcggatgacactggcgttattgcaacatatgttgtaactaccactggcctgacagttaaggaataataccgagggagacctacctatcataccctccaaacaacccccggacgggaacttcccgtccgggggctcttctttcatgcgattcaaccttggaacaaaacagcaaagaagctcccggggtatccccgggagcttctgctatcttctgttgattacagtcaaacaggcaaaattactttgcaaaggaaatgccagaggtatcaatggtataagtcacaatgccttcttctttcccaaaagcagtgttgttcgtttcgaaatcatcaccataggtacctttcgcgttgctcacaacttcaagcttcacattctcgccctgcatcacaacaacggaaagctcaaggatgtcgcctctgatgtcagtgtaccctgccaccttaacaccatcgctgactctgccatcggtagacgcaccggccagggccttgttggtctgacgaatggcaaccttctcgccgcttacgggaatctttacggttacggtagtagccgctttaccttttaagctatcaaggtcaaacccgctaaacaatccaccgtttacattcccgatattcttgctggtcaatttttccacattttctgcaacggggtaaatcgtagaactggtggtaggcagaacctcgtccacagtcaataccccttccgcactcacagtggttttcacaaccggctcagtacccttcagctcgttgttggtgtccacaaagaggaccagcagttcatccttgttgtcggtgtcgacaacataaaccacgttcttttcgaagctgccatcctggttgtggtcggttgcctccgcgatggagccaccttcttctcctgccacggcctcggtgtccacatagatcactttggtgtcgctggtaatcttgtactcagtggaattcccgatgaaggagacggtctcttcatccgtggctgccacggctgctgcggaggttgccagattcagcgcggaaatctcgtccccggaaaccttcacgaaagagcccttctcaatgtcgcccttcacattaccggtcttaaccttgatggtctcgttctccgccccagtccagacgaggaaggaagtgtactttgtgttgtcctcctgggtctcaccaagggtctttaccacgtagccatagatgtcgctgtacgcggaaccgggtacgtcaccttcaacagtaatggcagccagctcgacgtaggcatagccggaggtgttattggcgtaggcaacaaccgactcccgagctgcctcactccaggccttgacatcggcgccagtcagcacagtaacgtcaccctcgccatctttcacaaagacaactgcgttatcattgacgcgcaggccgccgatccggtcatcaccgacagttttgttgttggtggtggtgtcgaagttcgcgtcatcacccacagagatggtcttcaattcgtacttgtcgccgtccatctcaaaggcccacagaccatcgttgacctctatgacggtcgcctcgtcgtcgccctttgttacagcatcgctaccatccacagacttaatctcaatctcagctgtctcgccattggcaaagacagctctggccatcagcgtagtctcgccgtagctgacctttttctccgtgccattgatatagacaacatcatccatagagatggaaccggaaaccagctccgcagcgaaaatgtagccattcaccacgacagcctcgacatcgttgcccagttcaagattggtgttagaaacaccgctcgccagtgtatagacttcgccgtcaatggtgtagtcatctccgttcaccacagtgacctcaccggaaacaacctctgccttggtcaaggtgtccttcccgtcagcggtattggtgccggaaacgatgacagcgtagtcgtctttggcaatgccgtcgtagatgttgcagtcctcaaactcatactttccgctggcctggatatacttggagccaacgtaagtaacctctgccactgtgaagggcagatagaccacgcagtccacctcgtcgtcaccatccaggtcaatcacgcggacggtgtagtagttctgtgcatcagtagacttcttagcagtataggcattttcagcatagtattcaacaccatccaagcccttgtcatcatcgaccttgtacttcaccccatcaattttgatggaatcctggtcattggtctcaatatctccggcaatgccttcatagagaacctgggagtcttctgcatagatgccgtagacaggcttatctgtggtgtttttatagacaacattaacctgctgcgcaaacaacgcagtatagtcggcagcgctggagaacgtatgttcattattctcgtcgtccgtgaacgtgtagtcatactcgccgttcttgtcgttccacttatacttagtcatagtgagggtgtcataagtgtcggcatcattggtcatcacggccttgtacttgtcgtacagcagagtgtaatcatacttattgctgccaaccgtggcgggtgccttatcctgcacaaccaccttggagaccagctggccgttctcggtgaccagggtgtaggtgtactccacctccacagcctggagcgcattccagatcatctgggccgcgttgtcacgggtcagcgcagcggagacatccatgttctccagaccctcatacaggcccttctgggtggcaatcacgttgacgttggtgtcccagccgttgccggtgaagttggcctcatcggcgcgatagcccagggccaccagcagcatcttggccagctgagagccggtcacgttgccagcggggctgaatcgaccgccacccacaccggacacaatgccctgggctgcgcaggattcaatgtacttctctgcccaagcgtcagcggaaccgcgcacgtcagagaaagtaggcgttgcgggaacagcaaggttaggctccttgccgccgttgagggccacgcagatcatcttggtgatctcagaccgctcaatgttccgttccggatgataggaaccatcctcatacccgccaataatgttcagcgcagtgcacatattgacggcctcggtgttctcgatcttgtcctgatccgagaacgccgccccggcgcccatgaccatgacagacagcatcacagccacacagagcaccaggctcagaaccttcttctgggggaatcccttatccatcaatgctttgctccgcaatttcccacggattttacacggaactcccacggatttttttcgggttcaacttcttcctattgccctaaaaatgtgccggtggagcacactgctttgtatccggcggaggaaaaattttctctgatacagagacaatgacgtacaatattttgaaagtttgccttgataaaagtgagaaaaaagggaagaaaaattgataggttgacaattttcgagcgcagaatcaccaaaaaaaacagggcgcttcccggggaaaccggcaaaaagggaggaagcgcggaaaagttgtgttgacacttgaagattctaaataaccgttgtataatacaaaaaacgcaaaaaatccatgaaaaagatacaatctttggtttacatcgaaaaaagttgacaaaaagtcagatacacgaaagcggcgtgaatcatttgattcagacaatgctttttgtataagaaatgaaaaggagagaaatgacatgaagaaaaagttgctttgtacagccttggccgctgtgatggtcctgggcttgtgcgcctgcggcggtgatgagcagcccgcgggagacaacaacggtgagagcaccgccacgggcgctgctttcaagctgggcggtaccggtcccctgaccggctctgcggcaatctacggcgtggccgccaaaaacggcgcccaaattgcagtggacgagatcaacgcgctggggggagacatccagtttgacctccgttatgaggacgatgtcaacgaccctgaaaaggctgtcaacgcctacaataccctgaaggactggggaatgcagatctccctgggttctgtcacttctaagcccggtgagtccacctccgtggagaataatgcggatcgcatctttgcgctgacgccctccgcttcctccgcagccaacattgaggggaaggataacgtcttccagatgtgctttatggaccccaaccagggttccgcttccgcccagtacatctctgagaaaaagcttggcacgaagatcgctgtgatttggaaaaatgacgatgtgtattccaagggaatccatgagaacttcctggaaaaggcggaagaactgggcttggaaatcgtcagtgacaccacctttgcagacggcaacgacacggacttctccgtccagctggccgatgcccaaaacaaaggcgcggacttggtgttcctgcctatgtactatcagcctgcatccctgatcctggcccaggccaagaatatgaactatgctcctgcctggtttggcgtggacggcatggacggcatcctgacgatggagggctttgatgcaagcctggcagagggtgtcatgctgctgacccccttcaacgccgacgcagaggatgaaaagacccaagcctttgtgaagacctatcaggagaagttcggtgaggttcccaaccagtttgcagccgatgcctatgactgtgtttacgcctattatcaggcgctgaccaacgccaaggccacccccgacatggacgcggaaaccctgtgcgacctgatgaagaaggaattcacctccatgaccttcgatggtctgaccggcgttcaggtgacctgggatgagaccggcgcggtctccaaggatcccagaggcatggtcattcaggacggtgcttacgtcggattggattgatcctccaacgaattggcatactgcggctggggcggcttatcacaagccgccccggctgtcttccaaaggacagcgcggatcggaaagaggctgccttgtccggccgctttccgatccgcactgaagcattctccaagtgctgacgatgaaaaaactgaaagatatgagggaaccaatatgacctttctgagttttctgatcagcgggattagcttgggaagcatttacgccatcatcgccctgggctataccatggtctacggcatcgccaagatgctgaactttgcccacggcgatgtcatcatggtgggcgcgtacatctgcttctatgccacttcccgctttgagctccccgctgtggtgggcgtcatcctggccgtgattgtctgtacgatcctggggatcgtcatcgaacggctggcctataagcccttgcgggccgcgccgattctggctgtgctgattacagccattggtgtgagctatttcctccaaaacgccgccctgctgctgtggtcctccaatcccaaggtgtttccccctgtggtggccaacgggaacctctccctgtttgacgggcagctgaccattccctacgtgacgctggtgaccattctcgcctgtgtggtcattatgatcgccttggtttggttcaccggcaagaccaaaatgggcaaggccatgcgggcctgttcagaggacaaaggggcagcgcagctgatgggcatcaatgtcaatgggaccatttccctgaccttcgccattggctctggtctggcggccattgccggtgtgcttctgtgttcggcgtatcccaccctggtgcccaccaccggcgctatgcccgggatcaaagcgttcaccgcggcggtgttcggcgggattggttccattcccggcgccatggtcggcggcatcctgctgggtatcattgagatctttgccaaggcgtacatctccacccagttgtctgacgccatcgtgttcgcggtactgatcatcgtgctgattgtcaaaccggccggtctgctgggcaagcagatccgagagaaagtttgaggtggcagccgtgaaaagaacattgcgtttgaacaaaaccacccgcaacaattatgtgacctatgccgttgtgattcttgcctttctggtgatgcagattctcagcagcacaggcggcctctcctccaccatggagggaatgctggtgcccatttgcgcctacgtggtcatggccgtttccctgaacctgacagtgggtgtgctgggagaactctccctgggccatgcgggatttatgagtgtgggggccttcaccggcgtcaccgcggcggtggcgctggggaaccacgtctcctccgggcctgtccgtttgattgtcggtatgattgtgggcgccctgtttgccgctttggtgggctttctcattggcatccctgtcctgcggctgaagggggactacttggccatcgtgaccctggcctttggagagatcatcaaggggattttcaacaacctgtttgtgggcatcgacagcagcgggctgcatgtgagcctgctcagcgacaagaccaacctggcggaggacggtcagttggtgatcggcggtcccatgggcctgcagtctatccccagattgtccaactttgtcatcggtgtgattctggtcctgatcaccttgattatcgtgtttcatctggtcaacagccggtctggccgggccattatggcggtgcgggataaccggattgcggcggaaagcgttggaatcaatgtgaccaagtacaagctgatggcttttaccgtgtccgcagcgttggctggcgcggccggtaccttgttcgccatgaactatactaccattgtggccaacaagtttgactttaacacttccatcttgatcctggtgttcgtggtgctgggcggcctgggaaatatgctgggttccatcattgccgctaccgccttgactattttgcccgaggcgctgcgtgaattctcggattaccggatgctggtgtacgccattgtgctgattctggtcatgctggccaccaacaatgataccttcaaatccttcctgagacggctgaaaccaggacagaagaagaaaaaggaggttgtctgacatggcatcgaagctggtgacgatcccttccaacagtatgatcccggaacgggacattgataaaagccccattttagagtgtatcaacctggggattcagtttggcggcctgaaggccgtggacgatttcaacctgaccatcggccggacggagattgccggcctcatcggccccaacggcgcgggaaaaaccacggtttttaacctgctgaccaaggtgtatcagcccaccaagggaaccatcctgctggacggcaaggacacccatggcatgaacaccatgcaggtcaacaaggcaggcattgcccgaacctttcagaacatccgtctgttcaatgccatgtcggtggaggacaatgtcaaaacaggcatggaaaaccagatgagctacggcatgtggagcggtattttccgtacccccaagtattggaagcaggaaaagattgcccatgagcgggcgatggagctgctgtccattttccacatggaggatatggcgcagatgaaagcgggctctctgccctacggcgcccagcgccggctggagattgtccgggcattggccaccaatccctccctgctgctgctggatgagccggcggccggcatgaatccctccgagacggcggaactgatggagaacatccggaagattcgggacaccttccagatcgcggtgctgctcattgagcacgacatgaatttggtgatgaacatctgcgagggtctctgcgttttgaactttggccgggttatcgccaagggaaccccggaggatgtccaggccaatcccgctgtgattgaggcctatctgggcaaacagaaggaggcttgagcatgggaacgattctgaaagtagaggacatcaacgtctattacggcagcatccacgccatcaagggcatttccttcgaggtgcaggagggagaggttgtcacgctgatcggcgccaacggtgcggggaagtccacgacactgaatgccgtgtccggtctgctgcgcagtaaaaccggttccatctcgtttttaggggagagcttggccaaggtgcccagccataaagtggtggccaaaggcctggccttggttccggagggccggcggatctttttgcagatgacggtccaggaaaacctggagatgggcgcatttacccagaaaggcagcggcattcagcaggacctggagatggtgtacgaactctttccccggctgaaagagcggtataagcagatggccggaaccctctccggcggcgaacagcagatgctggccatgggccgggcgctgatgagccatcccaagctgctgatgctggacgagccgtccatgggcttggctcccattcttgtggagcagatctttgagatcatccaaaacctccataaagcggggacgaccatcctcctggtggagcaaaacgcccaagccgccctctccgtggcggaccgaggatacgtactggagaccggaaaaatcgtgaccaccggcaccggcgcggaactgctgtccagccctgccatcaaaaaggcttatctgggaggctgaggagcgttccctcttgagaaaatatcgtcttttcagacccggtctgtggattctccacaggccgggtttttgccgcctggtgggcccgccaatccgcacggtagagacagtgtacgaattttgttccgggagtttccttgctctttgttgcgaaaattagcttatgtttgctcaaaatattgcgtgggaacgccgtgtaaaatccgtgggaaattgcggagcgaagcattgcggggcaaggagttcccccagaagaaggttctgagcctggtgctctgtgtggctgtgatgctgtctgtcatggtcatgggcgccggggcggcgttctcggatcaggacaagatcgagaacaccgaggccgttgatgcgtgctctgcgctgaacatcatcggcgggtacgaggatggttcttatcatcctgagcgcaacattaagcggtctgagatcaccaagatgatctgtgtggccctcaacggcggcaaagagccgaatctggctacccccggtacccccaccttttctgacgtgcgcggcaccaccgctgcctgggcagagaagtacattgagtcctgtgtgtcccagggcatcgtgtccggtgtgggtggcggccggttcagccccgccggcaacgtgaccgcctcccagctggccaagatgctgctggtttgcctgggctatgacgcagacattgaggagtttaccggcaatgcttgggacaccaatgtaaacgtggttgccacccagaaaggcatctacgaagggctgtccggtctggatgtctccgccgcactgacccgcgacaacgcggcgcagatggtgtggaacgcactccaggccaccgaggtcacttataagtacactctggtcagcgagaacggccagctggtctccaaggtggagctggtcgacaagactggcgaaaatggcaacaagatcaccctgctggaagacaagtacagcggcgccggcatctacgaaggcatcctgactggcgccggcgaactgggcaccgccggcaaagacaaaattggaatgagtaacgttgacaagctcaacggcgccactttgaaagaggacgaggtaaccaatcagatctggacctactccaacgatgtgaccaacctgtacatgcagtatgtcaaagtcctggtcaacaacaagggcgacgcttacggcgtgttccccgtggccaaggaaaatactgtggtcaccgccgctttctccgatgtggagctggtgtctaaggcgaccagcaccgcagacggcaaagtgaaaatcgacggcactgaatataagtttgcttggatcgatggcgatcctggtgccgccgcccccatccagggccttactaataagacgatgaatgacctcaagaaggaggcttccaactccgccgacgtcatcaccttcatctccaacgatggcgacaacaagtttgacctggcgattgtgaacccgatgatcgagtttggcaaagttacttatgttggcgaggatgaaatcaccgctgctggcgaaacctatgacccggccgaggatatcattcccgacgatctggccaaggacgactacgttgccatttacaaagacctgtataccgacaactataagctggtcaaggctgacaaggtcagcggcaaggtgaccggcaccaagggcaatcccgccactgatgtgaaggtggacggcacctggtatgctctggctgctgagaagaatggatcgttcgatggcatggtcggaatcgctggtaaagaggccagcaacggtggcacctatgatctgtactgcatcaacggcgttgcctactatgtggatgagaagcaggctggttctaccgacaccgcatacgttttggctgcccctggctccatggacaccgatggaaactatcaggttaaactgctgtttgctgatggttccaccaaggtgatcggtgcggaccaaccctataactcaggttttgttggcgagttggttacttatgacatcaacgatggtgcttatgaactgaagaaagtagcatctggtaacacggctggcggggacagtgtcgttactctgaaaagctttgacaagaccaaaaagaaagtaactaccgatagcggcgattatcgtgttgcagactccgctgttgtctacgtaatctacaaagacggcggggacaagcagaaggtgatctccggcgaaaccctgaatgctctgggcgccaactttggcaccagcggcactgccgtgatcgatgacggtctggccaccgttgtcctgctcaagtctaactcctacctgcccggttccaacgcggataagctgtatggctatgtgacctctgatgttgtctccaacaaggaggacgatatctcgttccgctcctttactgtgtggacctccgaggaggaatccattgaggtgaaggtgaagagcgaaagcgctgatattaagaagggcgacctgatctccttcgagatgacagaggataacttcattgagagcgttaagtccgagagtgaagcggatataggctatcagctgaacgtgtccgatcctgtcgccatcaaggacttcaccgcttcctgggtgagcttctactacgacggtgactacgacctggccgacgacgcgaagtatctgtacgtcaacaccgccgacagcaagggcgtcaagggcggctccctgtccgaggcttccgagacagccaacgagggtgtctactatgcgaacgccaagtatgtgctcaacgatgacaaagagattgtcctgattgttgttgacaccaagaacaagtgggatgacgccgaaacggtgaagaaagatgctgcggctccgaagagtatttccctgactgctggcagcggtagcggattgactgtcaacggcttcacctacgatgctgctaagaagacctacgaagtgactgcgagtactttcgctgcaagctcagccgataaactgaagctgactgtgacgactgcggagaagactaaggataacatcactgtttctggtgacccggtgactgccggtgaatacacttctggcagtgaccttactctgactaaggctggtaaggtgacgttcaaagtgacgatttctcaggataactgcaatgacgttgtttacacaattaatgtcactgtctcctaagttgtcgtctgacgatttgaactgaaggattgagtaaaaaaggaaagccccctcgaaattcgagggggctttcccttttcgtcagctgatggccgccatgcaaatagattggtggctgccttacagtttctcatcttgccatagcacgcagtcgcccacatctctcagggagtccgttccaggcaagccgcaaaagagagttttggattatttctggaccttaattgtgaagttaatggtcttggtggccagaccgtcgccggtaatcacaattttacctgtgatgttgccctcgccagtcacttcaatatctgccttattcccagtcgcgataaccggaccattcttcaggatgttgccctccagcgtcatagttgcactcgtactgctggctgcggtcagctttacatcgaacttattagcagttcccgaataaccagtcagagttattgtctcgccgtcagtgatattaatagaggagccagtgaccgtcaaactcccagccgaagtagtcgcagtagcaacctgtgcttttgtcggagtagtcgcctcacgctgtgtgacagttacatccgttgtaccgttgttccactttcccgtggtatcaatgacaaccagcagagcctcgccgccctctacatagtaggacacgttcgcatagtactcgttggcgattccagtctcagaggctttctccaagttggcctcgttgccaatgcccttgacgtcctcggtgttgacctccagatacttcacatcatcatccaggttgatgtttgtcgctttcccgttgctgccgagcacaaccagatagtcgtcaccatagttgagcagagcacctgcgttcgtctcgatctcactcagcttctgaacaccctccgcgtagttgtcagaggtcagattcagtttgatgaagtcgccctttttaaccgaggtggttgccttctgcttgaccccttccaccagcttgccgtcggtggtgtagacgtcatactgcttatacttcacgttgttgtcgttgttttcagagacagaagagaccacatagccgtacagctgggtggcgttggcgccaggcagatagctgtcggaatcaatgtaggccagggagatcagaccgtcagtgaggacgtagtagacgttgccattcaggtcgccgcccagcccgttcagctcgttgccgctcagaacggtttccttgtccttggtgccgtctttataggtgacatagatcacagcgtcgctggcaaccttcttttcggccagagtcttatctgctttctcaaagcccgtcgtgctttcagcatagacatcgccgcccgccttgttcacagcggagacagcctccaattcatacacatcgtcggagacctcccaggtgaccagcttgccttccagaccgtcatacttttgatcggcgggaacaactttcgttgtcttatcggagaagagcaatttcacctgatagttgccgtttgtgtccatggagccaggggcagccaggaccagagcggtgtccgtagagccagcggtctctgcgttggcgtagtaaatcacgccgttgacaacataggcggtcacggtggagttgagttccacggcgtcacccttcttcatcagagcctgatagaagggggaatcaggggttgtattgccaaccttgtaccagttgtctccgatcttaacttccttaccagaatctttagtggaagtcactttgccagataccttgtctgccttgataaactctttgtcgccggtgtaggtgttttcatagtaggcaacatagtcccctttggccaggtcgttgggggcgatgacgtcgtcgaattcataggaattgccgccagccacaaattctgtcttggaaacgtaggtcaccttgtccagggaggagcttgcagacttcatggggttaacgatggccaagtcgatcttggagtcaccgtcattggagatgaaggtgatcacatcgccggaagcgacttcagcatacttggtgccggtgagctcactgatcttcagctcggttccgctggtcttttcaatgccctcaatggcaccgtcattgtagttgtaggcggtgccgtccacagagatcttggtgccgtcgatttttaccttgtcgaaggtagcggaggcaaccacattctggtctgcaacggggaatacaccgtaggcgttggtcttgtcatccaccagaaccttgatatactgccccatcaggtcagtgatatcgttggcgtacttgaaagtagactcacgggcagtggaaacagaggcgccattgacggctttcacctggagtgtcagcttatccttgccggcgctcttgccctgaataccatattcaccggaagccaccagaatgccttcgtaaacagaggcctcgtacttgtcgcccagcagagtgacacggacaagcttattgtcttcgccgatggcctgcttgtcttccgccacgttctgggtgatcaggttgccattttcgtcggtgacgatggtggttttgtactccacctcgtaggcattcatggcgttccacaccatctgggccgcactgtcgcgggtcagagcggcagcggtgtccatgctctccaggccctcgtacaggcccttctgggcagcacgaacattgacattcgtctcccaagcgctgcccacgaagccctcgatgccagcgtcatagcccaggcagaccagcagcatcttggccagctgggtgccggtcacgttgccgttggggctgaaccggccgccgcccacaccagacacgatgccctgggccacgcaggcctcaatgtagccctccgcccaggcagcgttggtgccgcgcacgtcgttgaacgtgggcttcgagttggtgctcacattgggctccttgccgccgttcagggccacgcagatcatcttggtgatctcggaccgcttaatgttcccttcgggcttgtaggacccgtcgggatacccgccgatgatgttcagcgcaacgcaggcatcaacggcctcagtgttctcgatcttgtcctgatccgagaacgccgccccggcgcccatgaccatgacagacagcatcacagccacacagagcaccaggctcagaaccttcttctggggaaagcccttatctcacaacgctttgcctctcaatttcccacaggttttccacggcgttcccacagcttctccaggtttttccgttccagtgatttgctcccgaatttcctgttgttcataaaaattcagtagacaactgcctctgatgtgagtacaataaaaccattccacagaaaaggacaaaagatatgaaaaaactccttcgtttcctcttgatctgtactctgaccatcggcctttccgcctgtgagagcaatgcctccaatccccaaaccacagggaatgcggatgcagactatttggggaagtacctctgcacgggaattacattggatggtctgaccatgaaccccaacgggaaatggttggagctgaacgcagatgggaccgtgaccacatttcttacagaggaagcggacgaagcggaatggaaattggaaggggaaaactttacgatgaccatcgctggcaagatggtaggagctggtacactccagggcaacgaactctcgttggaaatgatggggatggaatacacgtttgttcaggagggaaccggtcaggacgggcaggaggcatcctccagcagtggttcttttgccacgtttacctgctatggaaacctgtatgcggttcggtatcccacagaccttttccagcaagatccagctggattgtctgatctttacacagaagacggcgtcaaaggctggatcacaaagctggatacggaagaacgggtgacagaatggttggccggttttgatgaaaaagaaaccaacgagaatgtacaggattatcagaccatggaatacaccgtcgcgggctatcctgctcgggcaattgtatatcaggacgcagagggctggcacagtgaggtgatcgtcaactttggaaaagacatgggcaatgaaacctactccatgtatgcggcctatatttactttacaggggatacgtatgtatccgtatggaatgaagagattcaaggaatgatcaacagtttaagcatcgatggataatcgcaggaggatatcaatgtttttcaagcgacgttttctctcccttattctcgccctttttttgctggccgggctgacttcctgtggaggaccgcccgaagatgccggctcaggtccttctgcaagtgatctgggacaagaagcgcagccgagcgaccagccagaagatccctccctttcccagctcaggcgcgagttggatgagggcggatatttctgtggcattgctttcttggggaacctcccagacggtgatccggaggctctcccccgtgtcatccgtgaggcagggtatctggaggactacccctttttagaaacccttcccaaagagcaaatcatagcgtatgaaggttctgaagcctattgccttgttccccgggatcagaaggcaacccttaccgtacaggcctttctctcaaacgaaagcaatcactaccaaggggaacccggtgaaatcctatacgaaagccaggatggacgccctgtggttctcatcggaaatgtcagtgatatcatcccgaatctgttggtcacactcacgggggcagacggggaaaaaatggagtatcatcccgcgctgagtctttgtgatggtacggtagcacgcccggtttcgcccaatgtgtatgacttcagccgataccaggcggaggattctcccatatccgctgactttttagggcaatgggaatcagaggatggaggggtggtcttctcctcggacgggaccatgtctctctggtccggttcctccatggaccaggcaaccgatcaaaaaagcggaacgttttacgttatctccaattcaacccaatacccggctggagctgtattgttcgaactgacagatgaccatgatacccctgctttttgggggatttttacccttgccgttgacggagcaaccctcaccgcaacacacgtcagtggggatttattgtggggaaaggaaacggtactgtttacacaataaggagaccgtcctcctgcaaaagacatatcccggtgctttaccataggcaccgggatcgttttcattgggcctttttcattacataataactgcaaagttttgtgggagttccgtgtaaaatccgtgggaaattgcggagcgaagcattgatggataagggattcccccagaagaaggttctgagcctggtgctctgtgtggctgtgatgctgtctgtcatggtcatgggcgccggggc

SEQ ID NO: 2256 - DNA, 12056 bp, KLE1738
cccgccggggcttcttggccgggcggaccggcaggtctttggttctcccctgttttctggcctggcagaatgcctccgccgggcattgctggcacagaggcgccccgttgggcaggcagaccatagctcccaggtccatcatggcctgattgaactggccagggaaatccaaggggataatctcctgcaaggccgccgtaaaatggcgcttgccctgggtggtggtaatatccgtgtcatcccccatcactcgggcggccacccgcagcagattgccgtccaccgcggggacaggctggccaaaggagatggaggcaatggccgcggcggtatagtctcccaccccggccagggaacggatgtccccatagtctgtgggaaataccccgccaaaggtgtccacaatctgccgggcggctttctggagatttcgtgcccggctgtaatagcccagcccctgccacagcttcatcagctggtcctccggagccgccgccaaatcctgtaccgtgggaaaagcgtccatgaacttggcaaaataccccagcaccgccgccacgcgggtctgctgcagcatgatctccgacacccacacccgatagggggtgggctcccgccgccagggcaggtcccgggcatgttccccataccattggagcagggggatgggaagaaaagataacgtattgagcatctctatttctcctgttactttgcaatgagcagcgcagacagtgccgctggcagaggggacgacagggcaatctcctccccggtgacgggctggcgcagccgaagggcggccgagtggagggcaaaccgctggggaagagcctccagctccgtcccatagaggaaatccccggccagcgggcagcctaaaaacgccatgtgcacccggatctggtgggtccgcccggtctccaggcgcagcgccaccaggcttcgcccggcgccggttcgctccacggcatagtgggtccgggcccgggcgccctgggggcatacctgccgcttcagcaccgaccccggcagccggctaatgggctggtccacacagccccggcggggcaccggcaccccttggcataccgccaggtaggtgcgcgccagctcccccgtccgcagctggtgctggagccgctcgtgggcgtgggcgtgcttggccaccgccatgaggccggaggttccccggtccagccggttcaccggatggaaggccgccaccagcccctggtcccggtagtgggccagcagaaagttggccagcgtgtccccatggtgcccctggctggggtggacggggacgcccccctccttctccaccaccaccaggtcctcgtcctcatagcggatggtcaggggaccgggaaccggcggaatctgttcgctccccgccacgtcccccaccgccaccgagagaagctgtcccgcccgtcctgtttggttggtgaacacaggctgcccgtccagcagaatgccgtccggcagggtcttggcccgccggacactggcggcggacagcagaagctcctgccggagcagggtgtgaacggtcctccccgcctgggcctctcccaggcgcagggtcaaacggcgcatagacagacctcctctcttttctctggcgttgccgcgttttttgtggtacactttccttatgacagcatcccaaaggaggttatccgatgaatggcatcattctctatggcagccgctacggcgctgcccggcagtatgcccaagcactggaggagaggacaggcctccccgccgtttcctacgcagaggtaagggacttcggcccttttgacaccattgtctatgtgggcggtctctacgtcggcaaaaccaccggcctggccaaaaccgccagacgcctgcccacagaccatcccttccgcctgttggtggccaccgtgggcctggcggacccggccaacgaggacaatctgctctccattcgggagtccctggccaaggagctctcccccggcatctttgtccggaccgctcatgtccctctgcggggggccatagactaccaggcgctgagcaccaagcaccggctgatgatgaaggggctttgcgccattctccgccgccagcccgtgaccgaacgcaccgccgacacccaggccctgctggatagctatggaaacgccgtcagttttatcgactttgataccctggcccccattgaggcctggctgaaaaaaggatgaaagcgggttgattataccaccaaaccagggtctctggcaactcccaccccgggcctgacaggggtgtttttctccctcgcccagttggcgccgcctggttgacgaatcgccctttctgtgctatgctaaacccatcgtatggaaaatgagaggggaacccatgattcaaatttcttgctaatccaacggaatccgcagcatgtccagggaaaaaagggcttgctgcgccaaaagcaagaatgtgaagaatctgctccccggacctttcccttccccaccgctctggtggtgttttgtattgtcctgagccgcaagaagacttccttcttgcggctcttattttttgcggatttcccctcttcaacggccagagaaaggagtgctgcgcctatgtctatgatcaaagtggaagatctcaccttttcctacccggcaagccatgaccgcattttcgactcggtgtcctttcaaatcgacaccaactggaaactggggtttgtgggcagaaacggaaggggaaagaccaccttcctccagcttctgatgggaaactacccctatcaggggaccatcgtctcctccgtcccctttgactactttccctaccccgtggccgaccaaacccaatggacccaagatgtcctccagtcggtctgtccccaggcccagtcatgggaactgctccgagagctgtcctacctggacgtggaccccgaggtccttttccgtccttttgccaccttgtccaagggagagcagaccaaggttcttctggcggcgctctttctcaaggagggacatttcctgctgattgacgaacccaccaatcacttggacacccaggcccgggacttggtctctgcttacctgcgaagaaagcagggctttatcttagtctctcacgaccgtcactttttggatggctgtgtagaccacattctatccctcaaccgcgccaacatcaccgtgcaaaacgggaccttctccacctggctggaaaactttaaccggcagcaggcctttgagcaggcccaaaaggaagggctccagaaggacatcgcccgcctgcggaaggcggcccggcagacctccgtctggtctgaccgaatcgaggagaagaaatacggcgccgggccggtggaccgcggatacatcggccacaaggcccaaaagatgatgaagcgcgccaaggccatagaagccaggcagcagcaggcaatccaggccaaatccggccttttgcagaactgggaacccttggaatccctcaaactctctcccctgccctgccggggagaccggcctttggcggtcttttcccaggtcaaagtccagtattgcggacgggatgtctgcggcccggtctcctttgccctccatcccggagaacgggtggttctggatgggaaaaacgggagtgggaaaagcagcctgctcaaggtcctgctgggggaatccatcccacacagcggcaccatcaccaccagtgccggcttggtggtctcctatgtcccccaggacaccgcccacctgaacgggctgttgtcccatttcgcggaaaaacaccatttggacgagagtctcttcaaagggattctgcgaaaaatggggtttgaacgggtgcagtttgaaaaaaagatggaagatttctctgcgggccagaaaaagaaggttctgctggccgccagtctctgtcagcccgcccatctgtacgtgtgggatgagcccctcaacttcgtggatctccacacccggctccagattacctccctgctccggcaagcccaacccaccatgctctttgtggagcatgaccgcgcctttcaggaggagatcgccacccaaaaaatctccctgtaatcctttcttgccatctgtgccaaagatgcgtataataggtgtggattcacgcaggattggagtgatctttgtggccaacacctttggcatctatatccacattcccttctgcaagagcaaatgcgactactgtgacttctactccctggccggtcaggaggagcagatggaccgctaccagcgggcgctgctgacccacctgcgctcctttggcccccggatgaagggctgggtggcggataccgtctactttggcggcggcaccccctcctactatggggaaaaacgcctgcgggagattctctccctgattcagcggttgtttaccgtcagccgccaggcggagatcaccgtggagtgcaacccagacagcgtggactggcgctccatggcccgtctgcgccgcagcggggtcaaccgcatctccctgggggtgcagtccgcggacccccagcagcttcggtgcctccaccgcatccactcccccaagcaggtggtccaggcggtggcggacatccggcaggccaaaatcaacaacctaagcctggacctgatctacggtctgcccggtcagaccatggcctcctgggaggacacgctgcacaaggccatgagcctgtcccctgagcatctctcctgctacggcctgaaagtggaggcggacacgcccttggcccaccaggtctccctggggctctccctgcccgacggggatgcccaggccgatctctacctccgggctgtggagcttttgcagcagggaggataccggcagtatgaaatctccaactttgccaagccaggcagggagtcccggcacaacctaaagtattggacaggccgggagtacctgggcttcggccctggggcacactcctatttcggcggtcagcgctatgcctatccccgggacctggagggatacctccaggccatcgccgccggcgcggcccagctggaggagattcagcccatcaccccgccggaacaggcccgggagtacctgatgctccgcatgcgcactctgcggggcatcgaggaatgggaataccgccgaaagttcggcctgaattttgagcccatcgcccggcggctggagtttttcgagagccatcactgggctgagcagtccgatcaccggtggcatttcaccccccagggcttcctgctctccaacaccttgattttagagcttttagatgcccagtcgggcaccatccaagagcaaacgtactggaaggaactcatcggccagcccgattccgaccaggacccataaattttccatcccggaaaggagaacccatgaaatacatcttgatcatcggagacggcatggctgacaatcccgtccccaccctggacaacaaaaccccccttcagcacgccgccatccccgtcatggatgggttggccgccaagggtgaggtgggcaatgtggtcaactgccccgccggtctgcccgccggcagcgacaccgccattctgtccattttcggggcagaccccaatgtctgctacacaggccgctcccccttggaggctgccgccacaggcatccagctccagcccggagacatttcctatcggtgcaacatggtcacctatgaggacagcgacctcccctttgaggaaaagcgtatcctctcccactccggcggttccattgaagggaaccagtctatccagctgattaccgacctcttccgggaccccgccttccagcaggccgcccagcaggccggcatggtggtccaccccgccgcctctttccggcacatcgccgtgcagtccggggcctccatcaccgggatctccctgcttcccccccacgaccatctgggggaggtcattggtcccctgctcccctcgggcaacgacaacgcccaagtgctcaaatctctcatgaagctggctcaccaggtcctggaccaccaccccatcaatgaacagcgccgggcggagggaaagcgccccgccaacggcgtatggttctgggcggagggcagcgccgtggccctggaatccttctgggaaaagtaccacaaaaccggcacggtgatctccgcggtgcccctgtgcttcggcatcgcccgtctgtccggtctggatattcgggaggtcccgggcgccacgggagaactggataccaactatgaaggcaaggttgccgccgccctggaggaactgcgcagcggcaaggactttgtggccgtccacgtggaggcccctgacgagtgcacccacaacggggacctccccggcaaactccaggccatcgagtggctggacagccgggtggtggggcccttgacccaggccctggcggaagagggcacggattaccggctgctcattctctccgaccacaaaaccctcaccgccacccggggacacgacgccgaccccgtcccttatctgctctatgacagccggaaagacacgggtctgggccttccctactgtgaagaatccggccaaaagggtcctgcctaccccgccggcgccccggtgctgatgaaaaaactctttgcactgtaagtccctatcctacgacatacccgaatcactatcacgaacggaggaacacccctatgcatgaaaccgccttttccccggccaacatcctgctgcctcaggactgcggcctgaccaaatgggccgtggtggcctgcgaccaatacacctcccagccggaatactgggagcgagtagaccaattcgtcggtgacgccccctccaccctccggctgatcctgccggagagcaagctggaaagtgagcacgtggaggaggagattcagaaaatcaatcagaccatggagcagtacctggaagagggccgcctgcgggagctggaggatgccatgatctttctggaacgcaaactctccaacgggaaaacccgtctgggcctgattggcaagctggatctggagcagtacagctacgagaaggggtccggcacccccattcgcgccaccgagggcaccgttctctcccgcatccccccccggatgaaggtccggaaaaacgcgcccatcgaattgccccacattatggtcctcatcgacgaccccaaaaaagaaatcatcgagcccttcctgcggaaggagagcaagaagcagatgcagatgatttacagcaccaccctgatggaacagggtggccgggtctctgggtatcttctctccaaggaacaggccgacaaggtgcagaagcagctggccggcctggcagacccggcccgtttcgctcaattctaccacgccgagggcaagcctgtgctgacctacgccatgggcgacggcaatcactccctggccaccgccaaggcctgctgggaggagctcaagcccactctgtccgaggcggagcgccaaacccaccccgcccgttacgccctggtggagctggtcaacctccacgacgactccctggagtttgagcccattcaccgggtcctcttcggggtcgatcccaagcagcttttggcggacctgctggcggcatatcccggcgcccactatggggcaggggagggccaccagatcacctatgtcctgcccggggaaaggggaatccttaccgtcccccatcccaccgctcagttggaggtaggaaccctccagaccttcctggaccagtatctggaggcccatggaggcaaaattgactacatccacggcgaggacgtggtggagcagttggtgcagcagcctgacagcatcggcttcctcctccccggcatgggaaaagaccagcttttccccaccgtgatcttcgacggcgcgctgccccgaaagaccttctccatgggagaggcccacgataaacggttctacctggaggcccggaaaatcaagtgagctctctcaccctctccgcccccgccaagctcaacctgaccttggatattttggggacccggcccgacggctaccatgagatggagatggtgatgcagtcggtctccctgtgtgatgaaattcatctgcatttgggctttcccggaggcatccgggcggagtccggcctgcgctttctgcccaatgacaagggcaacctggccgtggccgctgcggtggcctttcggcaggccaccggccagagctggacggatctgcggatttccattgaaaaacgcatccccgtctgcgccggcaccgccggcgggagcagtgacgccgccgccgttctccgggggctcaatctcctcaccaacgcgggcctttccctccaggacctggcccggattggcgcggcggtgggctccgacgtcccgtattgcgtgctgggcggcaccgccctggcccagggacggggggaaacgttaaccccgctgcccgccctgcccgcctgcttgttcgtcctatgtaagccccggttttccatctccacccctgccctgtttcgggaatgggacaagaaaaggcgccatctccgcccggataccaagggaaccctggccgccttggcacaaggggacctgctggggattgcccgccggacgttcaatgtctttgagggagttcttcctccccaccagcaccgggaaatcgaagcaatcaaacataccatgatccaagccggtgcgctgggcgccgcgatgagcggcagcggtcccaccgtgttcgggatcttctctcaggcatcccaggcccaagaggcttgggcacagctgcgggaggactacgacgaggtctttctggcagagcccctggtgcaaaacagcataccttgagcgcgtcgtgaaaaaattttttctccatgcgtttcccagcggaatgggacctgcccgtgtataaaacgaaaaaacaccgtccatactttcagcaaatacgaaagtggacggtgtttttttatgaaagcattacatagtttttcctttccttggcgtcgggtgctggccttgttcttcgcctttctcgtgtgtactgccctttgggccgaggccacccaagctcagttggcggaaaaggtaattcgtctccatgtcctggccaactcagacagccaagccgaccagaccctcaagctgcaggtccgggataaaattctggcgcaaacggcctccctgctctccggccaggaatccgcagcccaagccgccgccattttacaggacaacctggacgcactggcccagaccgccgcccaggaaatcgccgcccggggctatcactaccctgtaaaggtctgtctggaggaaacttggttccccacccggcagtatgaaaatgtctcccttcccgccggaaattatcaggcccttcgggtgctcattggtgagggcgcaggaaaaaactggtggtgtgtggtctttccctccctctgtctctccgctgtcacagaggaatctctgcaaaccgccggtctgtcccaccaggagtatgcactgatcagtgaggaatctcagccatacaccatccgattcaaagctgtggaatggtgggaggcctgtaaacattggttttccagaaacgaatcgtaacacgctcttgccgggatggcacttctatgctaaactaaagacaatcccatcataggcagagaggagtgtttctatgaccttttcctgggccaccattcgtgtacggaacctggaggacagccttgccttctatcacaacctgctgggactgcccatccatgatcgctttggtcctcctggacatcaaatcgtcatgttaggcacagaccccggcacgaaactggaactcattgaaagcgccgagcccctgccggaggttccagcccccggtctctccctgggatttgcgccagaaaacatgcgcaagcttctgtccaccttggaggcggccggaatctcctgcccgccccctatgtcccccaatccatcccttcgtttctacttcatacaagatcccgacgggtatgtgattcagctagtggagacactctccccttaaacagacacccaatcaaaaagcacaggtcgttttgacctgtgccttttctttgttcatccatgggctcgcccgctgagctccaccacagttaagcagaacacgcaggtcctgttgagtaccgcttccgggaacgtccaatctgtccggtcagaatagtgcttcataataacctgcaagcccgctgtcttttcttccggcgtcttcagttctgtaatcgttccttcccccaccacactttgataggccaccgaaaaatcacagggcttttcatctggcttcagctgacgattggtgtccaattcaaatcccgcatagcccagcttccggcatagctccaccttccgccctgctgctgcactgtgaaaatagaacttggacacgccgtcctcccggtgatatccaaaactcaggggtacaatatagggatgggtgccatccgcaaaggccagccgaacacagtcgcagctttgaatgatggcgtcgatttgttctttctccgtgaccgctaagtcctttcttctcatttccatgccatttcctcccacagccaaacaattttctttattatagcaataaaaaacaggacagtcaactgactgtcctgtttcctatgttggcgttacctatttttccagttcgtctccaaacaagtatcttcggcgcaagtgagcttaacttccgtgttcgggatgggaacgggtggaccctcactgcaatcaacaccaactcgctgtcgcaataacagcttatcaaatttttcgcgtcttgtcaaccaaaacgtggtgacccgtacgggaatcgaacccatgtttgcggcgtgagaggccgccgtcttaaccgcttgaccaacgggccgttggtacaccttcagggactcgaaccctggacaccctgattaagagtcaggtgctctaccagctgagctaaaggtgcatactgactcagtttcattcccttgctttcttttccctcaagaaaaggttgtggcaatatccacaccctcaaaaccgaacaaagtaaccgccataccccaagcaagcgcctgcacttcttactcttaacctgagactcaggtcaagccctcggctgattagtaccggtcagctccatacattactgcacttccacctccggcctatctacgacatagtctctgtcgtgccttactcctcgaaggatgagagatcttatcttagggaaagtttcacgcttagatgctttcagcgtttatctcgtccgcacttagctaccctgctatgccgttggcacaacaacaggtgcaccagaggtgcgtccatcccggtcctctcgtactaaggacagcccccttcaaatctcttacgcccgcaacagatagggaccgaactgtctcacgacgttctgaacccagctcgcgtgccactttaatcggcgaacagccgaacccttgggaccgagtacagccccaggatgtgacgagccgacatcgaggtgccaaacctccccgtcgctgtggacgcttgggggagatcagcctgttatccccagggtagcttttatccgttgagcgatggcatttccactcacataccaccggatcactaactccaactttcgttactgctcgagccgtcactctcgcagttaggctggcttatacgtttacactcaccgcacgatttccgtccgtgctgagccaacctttgagcgcctccgttaccttttaggaggcgaccgccccagtcaaactgtctgcctaacagtgtcccccgaccggattcacggccgcaggttagaaacccagcaatccaagagtggtatcccaagggcgactccatacgacctgacgaccgtacttccatgtctcccacctatcctgtacatgaattaccgaattccagtattaagctgcagtaaagctccatggggtctttccgtctagttgcgggtaactggcttcttcaccagtacaacaatttcgccgggtgggctgttgagacagcgcccaaatcgttacgccattcgtgcgggtcagaacttacctgacaaggaatttcgc

SEQ ID NO: 2257 - DNA, 10498 bp, KLE1738
cccggcgccctccccgccggcgtctacggcccggaggagattcgcagggggattgtggaccgcctgctgggagagcgcatgggcaagcccggagaggtgctcaatgggtttgtctggcgttttctgttctcccgggagatcattcaagggcataacatggcctttgccggggcgtatctggaggacgagctctttctgctggagtatttctgttatgcccggaagctggccatggtggaccagccggtgtaccaatatctgcaaaatcccgtgtccgtcacccggcggtatctgccggactatatgcagacctttcagggctttatgaaggccaaggaggacctggcccagcgcatgggcctgggggaaaatatgcccctctggcgggaaaactcctactggtcggggctgctgatcgccattggcaatgagtttgccgccagcaacgccgcctcactggcggagaaacgccggagaatccggggcatctgtcagctgccggccatggcccgggccattcaggccattcagccccagggcctgggccggaacaaacagattgtggctgacctggtccgccggcggcggttctttttgctctcgctgttgtatgggatgaaaaaccgagggtgatccgatcagtgaagatgggggtaggggagaagcccccatgactttctggattgcggattgacaaagtatcttcctatggtatcctaaatttaggagggagaacccgcatcagaaaggagctatcctatgagaaaaacttggattggtcccctgtgcatggttgctgcggctctgtgttgcgtgctgctgggagagtgggcctcccaccgtattctggatgagggatcgccggtgtctttccagacatatcaaacccaaacccaggcggaatatcggcatctgggggaggagcccatggattactgggagacctatacaggtttctttgacgattttccattttactgtaccgaagagatgctggaggaggaattgcaggcgattcgtcagtggtcggagacaaagatttctccagtatcctacgaagaggcaaacgacgccgttgtggcggcctttgccaagtacggtgtggaaggtggactatacccaccggaggaagggcaggcttttttctgcaccccggtgattctggataacacagtccgctatattgagagcgtggcccaggcccaacagcagaaagagacggcaggggatggcgtatatgtcaatcaatgataccatgatgaaggaaaggagtgattgcctgtggaagtggtccagagcagcgtgctcggacgcctgctgctcccggtgtggctctggctgcgggcgcggtatgaatacagtctgctggccagggtgctccgggggattgcccaggcctggagccgggcctgcgccggaagtgtcctgatccaatttgtaacccgggagggctgtctgtccaaggcctggaaggacagcggcctgtgccggattttaaccttcctgctcagtattcccaccatcctgttgcagaagctgtatggcgcctgccgggaggcctttgagaacagtgtggccgcccggatcgtgttcgcggtggtggaggagacccccttggcggtggcctggctgatgctggtgatcatggtgatcccgttcaaatactggaacaacgcgtacagcttcgccgggtttctcctctgcttccttttggcggtggcctcgggcatgcggaagcggaacttccggctggatctggcctttttggggccctggattgtggcctttggggcgatgatcctggtggcctggcccctgtcggcctacccctccctgtccacccgctttctgctctactacgtgacgtgcatgctctgtgtggtggtcattgtcagtacggtggagacctggcggcatctgacccggctcatggccttttcctccctggctctcctggtgatgtccctggcggggctgtaccagagaattcagggggtggaggtcaacccctcctacgtggacatgaacctgaacaaggggatgcccggccgcgtctggagcttttatgaaaaccccaatacctttgccgaggttttgcttctgctgatccccgtggccatcgcttatatgctgtgcagcaagggctggctgggccgtttcctgggctttttcagtgccgctgtgggctgcgtggccatggccatgacctattcccgggccagctgggtggggctggcgttcgcggcggtggtctttgtggtgctgtggaaccggaagctcatccccttcgggattctggcggccctggtggttctggccattttgccggatacggtattcaaccgaattctcacaatatttaatacctctgacacctccaccaacagccgcttccccctgtatcaggcggcgggggagttcctgcagcagcgccccgtcttgggcgccggcctgggctctgacgcggtgcggcaggccatcggagatttgaatctcttccacgggaaggaccacttcgtccactgccataatatctatctgcaggtttggtgtgagacggggctggtgggtgtcatttccttcgtgggcggcattttgtggaccttcaagaagggctgccgggcagtggcccgggccacctgtgacccggtggtccgtatgaccatcctgggcggggccgccgcgctgatgggaaccatggtctgcggcctggccgactatatctggaactatccccgggtgatgctcattttctggttcgtctgtgccctgaccctggcgggcatccgcctggcggcccggcaggatggggaggagacgagcgcccctgtgtctgagtaaaaggagaccccagtgaaactcaaagatgtatggaagaaaaaggaggtgaccctgtcttttgaggcattcccgcccaaaaaagacagtgattttgcctcggtggcctcagcggtggaaaagattgcccagctgaagcccgattttatgagcgtgacctatggggcggggggcggtacctccgcctatacgggaaagatcgcccagattgtccaggcccagggggtgaccgccctggcccacttgacctgtgtctcctctgaccgggaccggattcaccatgagctggatgccctgtgccaggcggggattgagaatatcctggccctgcggggggactaccccgagggctatgatccgtcggccccccgggattaccgctatgcccgggacctggtggaggagattcgggcctatggtgggttttccatcggcggggcctgctatccagaggggcatgtggagtgccccagtcagagggaggacctgcgccacttgaaggaaaaggtggactgcggggtggattttctggtgacccagatgtttttcgacaacagcgccctgtacagttttctgtaccgggcccagcaggtgggcatcacggtgccggtgctggcggggatcatgccggtgaccaacgcggcgcagatgacccggattctctccctgtcggggaccaccctgcccaaccggttccgcatgatcctggataagttccgggaacgaccggatgccatgaagcaggcgggcattgtctatgccgccgagcagatggtggacctggtggccaatggggtccggggggtgcatgtctacaccatgaacaagccggatgtggcggcgggcattgcggaaaacctgtcgaaggtgctgggccggacatgagactggaccagagagagattgcccgctacctgggggccgccgggaagccgctgtggccggaggcggcggcctgggcccgggactgccagcgggaactggaagggacagtgaccccccgtctgctggggaggcggctgtccctttctctgtttgccggggagagccgggatttggactggcacctgcgccactgtacccagggcgttttgttcgcggtgacgctgggggcggagaccgaccgcctgctgcgccgctggagtgtccagtccatggccaaggcggcggtgggccaggcggtgtgcgcggtgtggctggatgacctgtgcgccgcctactgcgccggcctgctgccccaactgggggccggggaattcctgacaccccccttcagtccggggtatggggactggagcctggcggcgcaggaccgggttttggacctgctccaggcccccaagcggatcgggctgaccctcacggaagggggaatgctggtgccggagaaatccatcaccgccctggtgggcatcagtgaccggccggaggaggcctgcggccaaaaatgtatgcgatgcaataaaacagattgtcccttccggtccgcaccggagggagaggaagaaaggggcgttgtcctatgaaaccactgctccaggcgatgaaggagcgccgcctctatctggacggcggcatgggaagtatgctccaggcggcgggactgccggaagggctgcttcccgatgtgtgggggatggagaatccccaggcggtgcagggggtccaccgggcctacttggaagccggctgccgcctgattaccaccaatacctttggaaccagcgcccccaagctggccccctatggggtgaccccggcccaggtgatgaccgctgccgtggccaacgtccgggcggccatggaccaggcgggggtgacggacggctatgtctgcgcagatatcgggccctcggggaagctgctgcggccctatggggacctggactttgaggcggcggtggggctgtttgccgagaccgtccgggccgcggcccaggccggcgcggactgcattctcattgagaccatgagtgacttgtatgagatgaaggcggcggtcctggcggccaaggagaactgtgacctgcccattctggccagcctgatttttgatgagacgggaaaactcctcaccggcggctccccccgggcggcggtggcgctgctggaggggctgggtgtggatgtctttggtctgaactgcggtctgggccccaaggagatggcccctgtgtttcaggccttgtgggaggatacctccacccccctgctcctccagcccaacgcgggcctgccgcgcagcgaggggggcaaagcggtgtacgatgtgagccctgccgactatgcccggcagatgcgccctctggcccccatggccacccttttgggggggtgctgtgggaccacccccgaccacctgcgggcgctgatccaggccacccaggacattccgctgccggagattccccagtgggataccctgctgatctcctcctactgtcaggcggtggccctggacggccgggacccggtcatcatcggggagcggatcaatcccaccggaaagaaaaaactccaaaccgccctgcgggagggggatatggggtatgtattgggggaggtcttccagcaggaggaggccggcgcccacattttggacgtcaatgtgggcctgcccggcctggatgagccggcggtgcttacccagacggtggaggccatccaggaggtgacggggctgcccctgcagctggacacctccaaccccgccgccatggaggccgccctgcggcggtacaatggcaaaccccttgtgaattctgtcaacggaaaggaagagagcctggagaccatccttcccctggtgaagaagtacggcggcggcctggtctgcctgacactggatgacgagggcattcccgccgacgcccaagggcggctggccattgcggaaaagattgtccggcgggcggaggcgatggggattccccggcgcgagctgctggtggatggcctgaccatgccggtcagcgccggaggggacaacgccaaggttaccctggaaaccctccgccgggccaaggaggagctgggagtcaagactgccctgggggtgtccaatgtctcctttggcctgcccaagcgggagcagctgaaccagagcttctttaccatggctctggaacaggggctggatggggccatcatcaaccccaaaagcgaggcgatgatgggggcctaccgtgcctatcgggccctggcggggctggatgaccaatgccaggcctacatggaggccttccagggggagaccgccagttccccggctcccgtgtcgcaggcccataccttggggctgcgccagtcggtatgcaagggcctcaaggaaggggctgcggcccaggccaaggttttagcggagagcggccaggcggttctggacatcatcaatggggaactggtgcctgccctggacgaggtgggcaaagggtttgagaagggaactctcttcctgccccagcttctcatgagcgcggaagcggccaaggcggcttttcaggtgctgaaggagtacctccccgctggagagaacagcggagccccccagattctcctggccaccgtgaagggggatatccacgacatcggcaagaacattgtgaaggttctgctggagagctaccggttccgggtgctggacctgggcaaggatgtggcaccggaggccattgtggaggcggcccggaccaagaagattcccctggtggggctgtccgcgctgatgaccaccactgccccggccatggcagagaccatccggcagctgcgggccgcggatttgccctgcaaggtggtggtgggcggcgccgtgatcacccaggactatgccgacaccattggggctgactgctatgccgctgacgccatggagtcggtccactatgcccagcagatcctggggacataagagagaggaagcatccgagaaaagacaggacgccgccggttttccggcggcgtcctttgtatacaaaggttgacaaaagtagtgtagtgtggtatatttagcgcataaagataaaaatatatcacaaaatgaaacaggagggcacggagaatgaagggacgaagacggtatctatacggaagcttgggcctgctttccctgttgggctttgtcggcgtgttgacccaggagcgggtttttttgctgtttttcgccttcgcggtggatttcggacactggtttcggaaaaatgacgagatggtggaggactacatgaaccggtctgccgccttggcgttttacgttggtatggcggctacggggattctggggacgggagcggtgtttctccaggggatggatggacatagggcgctgctgacagggctggccggcggctttgcggtggcggtgatcgtccatgcgctggcggaactctattataccgtccgggaaagctgggggctggtccatgatccagaataggataaaggagtaccgggccagacacaacatgacccagggagaactggcggacctggtgggggtccggcgggaaaccatcggcaacctggagaaagggcgctataacccctctctggtgctggcctggcggattgcggcggtgtttcaggtgaccatcgaggagatttttacagtggaggcgtgaggactgccaggggaagcagtgccgttcaaataaaaacgtgtgtaccggggcgactgcgggtacacacgtttttttgcactgtaccgggaaagggattagaaggtatcccagtgaattttttcccggggcaggtcctccaggctgtggggctccggctgaatggcgggaaagcccagggagagaatggcctccaaggtgtagcgggccgggacggagagcagcgcgcggcagaaggcctctgtggaggtaccgtcctccgcctggcgcaggcggccttgaatccagcagctgcccaaccccaggtggtgggccatcaggtgcatattgctcatggcaatggcacagtcctcggtccagacgtcggttttctccggatcggcaaagaccagaatggcggcctttgccccggccagcatggctgcggaaccctggcggcaatgagacagggcttccagcgttttgggattctgaaccacaacaaactcccagggccggcggccccggctggagggggagaggagccctgcggccaaaatggtctccagagccctttgaggaatgggggattcggtgtaccgccggatgctccggcgggagagaagcaggttgagcaggtccatggcagagcctccattgacagagcgtttccagcctgaccagcgggcaggccgggcctgcctgcatgataccatactgcggcgcagcctgcaaggggagtccccgttccacagcgcgccacgctggagcagtgtgggcgggcggacaggaatgttttctctggaaaagtataaaatggaaggtaaaaagttctatatgcaatatatgtttgactttttgtattcttatattatacgcggcgtgtttctgggaaaccctttggtggatgattcgcggcgcggcagacgctggatggccctggcggcccttgcgttgagcctggtggtggctgcgggaaacgggctccaaaattatgccgactacggggcccagtataccggccttttagacccgcatttcctggcagctgtggccatcagctttctctcatccttggttttgatctctgctgcgctgtttctgctctgctggtgccataggagaggacagcacagactggagcggaacctggaggagagggaaccttgagaaagggagcgcgtgaggcggaaagcatggggaaaatggcgtaaacaagagaaaaagggagagccattctggttgggatggcgctccctttgcatattccgacgaattatttcatggacccgctgcaatctgccggccgcttgggccgggaggaagcagattttccgttgcaaaacccgtggggagttgctataataaaatgaatcatgctattttataaaggaggagagtaccttgcggctgaaatccttggaactgcaagggttcaaatcctttccggacaaaaccctcctctcctttccccatcccatcacggcgatcgtggggcccaacggcagcggcaagtccaatttgtccgatgccatccgctgggtgctgggggagcagtccgcccggtccctgcggggaggtaagatggaggatgtgatcttcggcggcgcccaggaccgcaggcgtcagggctttgcccaggtgaccctcaccttggagcagtgccaggacctgctgcccgacggtgggcaggaggtggcggtgacccgccggtactatcggtccggagaaagtgaatacgccatcaatggaactgctgtccgcttgcgggatgtcaatgaacttttcatggacacggggctgggccaggaggggtatgccctcattgggcagggaaaaattgatgagattctctcggccaaaagcacccagcggcgggaaatcttcgaggaggcggcggggatctcccattgccgccaccaaaaggaggagacccagcgcaaattggagcgcacccaggagaacctgctgcggattggggacaaactggaggaattggagctccagcgcacccccctgcaggcccaggcggaacaggcccagacctacttggccctgcgggaggagctgcgggtgctggaaatctccctttggatggaccagctggaccagcagcgtgccaagagtgcggccctggaaaaggatttggccacggcccggcaggagctggagagctgctctgtccaggccgatcagctctatgccaagggggagacccttttgcagcagctgcgggaccagcaggcccaggcggaagcactacgggcccagttccaggacaacgaagcccagctccgggacaaccgtcagcgggtggaacttctccgggaccgggtgcgggccaatgaagccggggcccagcggacccaggcagacctggcgcagcagcagagccgccggcaggccctggaggccgacctggcccgtcagcaggcccagctgacccagctgcgggcgcaggaggacgccctgcaaacgcggatggaggcggtgcggaaggacttggaggatacccgggaacagcttcgccaggcagactcggcttggcaggcggcccttcgccgggaccgggaggaactggcagagtgccggcgccgggaacgggaggcggaggaggcatggatggccctgcggatgcaggagcacaccttgggctcccgggccaagctcctggaggagatggcccagcactatgagggctatggaaaaggggtcaaaaccgccatggaggaggtccgccgggggaatctccggggggtcttcggcccggtgggtgagctctttcgtgtctcaccccgggataccgtggccctggagactgccttgggcggggccatgcagaacctgctggtagaggatgagcaggcgggcaaggcggttctccggctggtgaaacagcgggagggcggccgggtcacctgtctgcctctgaccgccctccggcccgctgtcctgcgggaggagggccttgagagggagccgggatatctggcggtggcagcggaactggtctcctgtgaggaggtcctccgaccggcggtgaacgccctgttggggcggaccgt

SEQ ID NO: 2258 - DNA, 10371 bp, KLE1738
cgcccgggagagccaactcccccacccgctccaacagcgccgggaactcccccttcccccctcccccgggatatggtatactgaggtgacaacaaccgcctgtccccccagacaggccaccgggagggatcgcctttgttctgcaactgtcttgccgtgggcgccggcggcgcgctgggggcggtgtgccggtacggcatgagcctgctccccgtgctccagcggggcgcctttcccctgcccaccctgctgggcgccatcctcatcggcctggtggtgggagccggccagcgctgggccaacctctcccccacactgctgctctttctgcgggtgggggtgtgcggcggctttaccaccttttccacgttctccctggaatccctggtcctgctggaggacggccggccggtgctcttcggcgggtacgtactcctcagcgtgaccctctgcctggccggggtgtggctgggaaagcacctcatcgcttaaacggtgttttccccatctgacaaaaaaccttcggccgcggcaggcaaaattggcggagcggtcagggaaaatcccatgacttttgttgcttttcgtggtaaaataaaaaggattatatgtatcgctccctctatgactttttgtcataaaccatacccaattgacaaaggaaaggaagacagcgccatgaacgaattcaagggaagcagcaagtacgtggtctcggaggacctgctgcggattgtaaacatttccatcgccctgcaaaagcccctgctcatcaagggggaacccggcaccggcaaaaccatgctggccgacgccatcgccgaggccctgggcaaaaagctcatcatttggaacatcaagtccaccaccaaggcccaggacggcctgtatgtctatgacaccgtccagcggctctacgacagccagttcggcggcgaaggggtggatgacatcaagaagtatattaagctgggcaagctgggggaggccttctccgccgacgagcaggtcatcctcctcatcgacgagatcgacaaggccgacctggagttccccaacgacctgctgtgggagctggacaagatggagttctacatccccgagaccaaagagaccatcgccgccaagcagcgccccatcgtcatcatcacctccaacgcggagaaagagctgcccgacgccttcctgcgccggtgcatcttccactatatcgccttccccagccaggacatgatggccgacatcgtccacgcccactacaacaacattgaggaccacctgctggagatggccatgaaggcattctatcagatccgcgacctgcccaccgtggccaaaaagccctccacttcggagctgctggactggctccaggccctccgcctgggcggggtggacccggacaagatcgaaaacgagctgccctacgccggcatcctcctgaaaaagaacgaggacctcaccgcggtaaaaaacgccaaaaaccgcgtcagaaacggataccgctggtaaagcgccccggacctgtccgccaagtttcataaaaggaggccactgtgtttattgatttattttacctcatgcgcgcacgggggctgaacgtgtccatgaacgaatggctgtccttgatggacgccttggagaaggggctgtgccggaacagtctgctggagttctactatctcagccgggccatcctcatcaaaaccgaggccgactttgacaagttcgacgaggttttcctggactatttcgaccggattcagcatatcgaggacatcccccaggagctcatggactggctccatgaccccaagaacatgaagaaatacgacaaggacgaggtggacgcccgcaccacctacgacctggaaaagctccgccagatgctggaggagcgccttcaggagcagcacgagcgccacgacggcggccagtactgggtgggcaccgggggtacctccaccatgggccactcaggctacgccgccaccggcattcgggtggggggcaagagccagcaccgccacgccctccaggtggccggggagcgggacttccgggacttccgagaggacaacgtgctggaccagcggtccttccagctggccttccgccgcttgcgccagatgaccacccgccaggacgggcccatggacgtgctcaacctggaccggaccatcgacgagacctgcaacaacgccggctatctccagctggagtttgaccggccccggaccaatgacattaaagtcatggtcctcttcgactccggcgggtccatgaccccctatgcccgtctgtgcagccagctcttccaggcggtgaaccgggccaacaactttaaggacctgaaaatcttctacttccacaactgctggtactctgagctctacaccggtccccggtgcgtgtatggggagtcggtgcagacccagtgggtcatcaacaacctcagccgggactacaaggtcatcgtggtgggagatgcctccatggccccctcggagctgacctgggtggggggcagctcctactacaaccgctacaacgccgagaccggcctgacctggctcaaccgcttccacagccgctttgaaaaaatggtgtggttcaaccccatccccgaggccatgtgggagtatgactacggctaccagaccattgagatgatccgcaacaccgtggacatgtaccagctcaccgtggaggggctgggacggggcctgaaaaaactggtgtcggcccgataacctgccacaaaacgccacgacagtccgccggcacggggcctcccggcccccggcgggctgttttcacgccggaactctgagagaggggggaccgccccatgaaaaaaccgggcagaaaactgcaaaaacgcaccatgggcctgctgcgaaacctgatgatcttaggggtcagctttgtgggcctgacggtggtgctgcagctggaaattgaatacaacctgctggtcctcatctacgccctgtccgcggtggcggtgctgctgtatcagctcatccgcaaccgcagcgaccgggacaagctggaccaggaggtagcccggagcaacttcctgatgaacgccgcccttcccgggggggatgtgcgtctgtttgagctgctccccgacgggatgatccgggttctctccccgggcaagggccagggcgggcagctgaaaaccaccctggaaacccctcgccgcctgctgtcctacctcaactgctccgcccagtgggaggcccccttcctggccgccctggagcaggccgccctgggccaggacagcgaagtggagttccagaccatggaccaggaggaaacctggattcagctgcggatggagcccctgcccgacaatgaggagaccaccgccatcggcaccatccgggacgtgacccagaaggtcaaggagcgccaccgccgggaggaggcctccaagctcctcacccggatgatggacagcaccatggccgggctggaaatcgccctggaggaggacacctggcggctgctctggggaacccagacctaccaggacctgcttcagcgggccggggcgcacgctccgtacagcgtgtttatccgagactacatcggccccaccatccatccccgggactgggagcagtactgccagtccatggaacgctcggccctgctgtccaccttcctggcgggccgtcccccggcccttcaggagtaccgggtaaaggtggaccgggccccgggctatgagtggcacgccgccgagctctactacttccgggaccccggcacccgccaggccaagtgcaatgtctttatccgacaggtcacccaggccaagatgcggcagctggaggagaaacggcagctggaggagaaggagcacatcctcttcctccaggccaaaaagctggtggaatccgaggaggagctggactttgtccacgtgatctcggagtactaccagggcatctacgtggtggacctggccgcggaccagacccgcagcatcaaggtcccccggtattacgccgacctgctcagccggacagaccattgccagagcagggccctggacctgtactgtcaggagctgatggaccccgcctatgtccccgccttccgggaggtcaccaactacgataacattcgccggcatctggcggaaaagcaccaggtggagctgctctaccggaagaagaacgacacctggctccggctgcgggtcttcgccatgcccggttacagccaagaacagcaaaaaaccctgtgggtgttcgaggacgacaccgccaccgtcaacctccggcaggaggaggagaaggcccggatcaccgcccaggccgccgaggccgccagccaggccaagagccaatttttggccaacatgagccatgacatccgcacccccctcaacgccattctgggcatgtcggagctggggctgcgggaggaggcggcggaggagaaagacaactgcttccgggacatccggggcagcggccgcatcctgctggagaacatcaacagcattctggacctgtccaaaatcgaggcggggaaaatggagatcaccccagagacctaccatgtgctctccaccctccacgacaccatcaccatcctgcggatgcgggcccaggagaaaaaactgaccttccgggcccaggtggacgagaccattccggccaccctttacggggacgacgtgaacatcagccacatcatcatgaatctgggcagcaatgccatcaaatacacccgggagggcaccatcaccctcaccgtcacctgggaaccccagggagaggacggcagcctggtcatccacatggaggacaccggcgtgggcatccgccaggaggacctgccctatatcttccaaagctatggccggctggaccgcaaagccaaccggcacattgagggcaccggcctgggcctgcccatctgccagcagctgacagagctgatgcacggccagctgggggtggagagcacctacggcgtgggcagcaacttctgggtccgcctgccccagaaggtcatcgaccctaccccctgtggcccctaccgggagggagaacagcgggagaacaaccagaaccgcaactccttcaccgcccccgaggccgtggtcctggtggtggatgaccagcccctgaacctgaaggtctgccagggcctgctggccccctacgagatggaggtctacaccgcccgctcggggcaggaggccctgcgccagatgacccaggtgtggcccgacctggtcctcatggaccacatgatgccggagatggacggggtggagactacccagcgcatccgggacatgggccggaaagacccctacttcgccgtggtccccatcatcgccctcaccgccaacgccatgaaaggggtccgggaggaattcctccagagcggcttcaacgactacatctccaagccggtggagctggacaaattggacgatgtgctccgggcctgggttccagaggacaagcagaaggcccccgccctccccctgggcgccctggtggccgagcccatccccgaggacctgcgggacctgccggacatcgacgtggcccggggcatgtcctactgcggcaccggccaggtctatcggaaaaccctcttcctcttccgggagcagatccccggccgcctccggcgcatccgccaggcctgggacgagggccgttgggaggactacgtcatcgaggtccacagcctgaaaagcgccgcccggtggattggcgccatggacctgggagaccaggctgaagccctggagatggccggccggtccgaggacttggaaacaatcgcatcggacacccccgctctcctgtcccggtgccaggccctgaacgaaaccttgtcctttctgtaaacagcaccagcgcccccttttgtcgtgggcgctggtgctgtttttcctcttttccgtggcacaccctgccctccccctgggaaggggttatagccggaggagcagcgttcccacctgatagaccccaaaggcggtcagccaggccaacgcggtctgataggccaccgcgaaccaaaaatgccggggggaggccatctcctggcgcagggcggccagggccgccaggcagggggcgcagaggagattgaacagcagaaacgacagggccgcaggcaccgtgagggacagcccggccaatcccccggggcagagaacccccaaggtgctcacaatgctctccttggccagcagcccgctgcacgcggccaccaccagccgccagtccccccatcccaagggggcaaacagtggggccagataccgccccaccccggccagcaggctgccagacaacgccccgctggacagctcaccaaacccgccctgctcccagccgaagctggcggcaaaccacaccgccaccgaggccagcagcaaaaggctccccgcctttcgcaaaaaggcccccagccgctggccagtcccccgcagcagctcccccagaggcgggagacggtaatcgggcagctccatccaaaagggcacgtcctcccgaggaaaccacgggctgccggacagcagccagctggacagcagcgccgccgccacccccaccagataggccaggggcgccacccaccagcccccgggaatcacggtcccggccaccagggcgatcaccggcagtttggccccacagggcagaaaggtggcggtcatggcggtcagccgccggcagctggtccggcggatggtccggcaggccaggatgcccggcaccccgcagccgcaggagagcacatagggcaccaccgatttccccgacaggccaaaccgccgcacccccctgtccagcagataggccccccgggagaggtagccgcatccctccagaaaggtcagacacaggaacagcgttgccagctggggcagaaagaccaacactgcccccaccccagccgccaccccgtccaccagcagcgccgtgagccagggggcgcaggagagcttttccaggccgtaggccagcagcggcaccacccccagatgctcccggcccaaaaaggtccaggacccctgccacagcgtctggctggccccctccgcccagccccccaccaggcagatggagacccagaacatccccagcagaatgaccgccagcagcggcagggccaaaacccggtggagcaacagcctgtccagacgctgggacagggattggcccccctgcccccgggtcagacagcgccgggccagcgtgcccgcaaaggcataccggccggcggcaatgatctcctcccggtcgtcctccaggtccctctcacaggcggcaatcaccacctccagccgctggcgcagcgccagtcccacccccagggcttggtccaccgcctggtccccctcaaagagcttgaccaggtaccaggcccgtcccgcggcgggcaggtgatccgatgccagaatctccacatcctccagtgcccggcgggcgcggggcggaaacaacggcgccggtttgaccggttccccacgccgggccgccgctgccgccgcctgggcggcctccgccacgccggtgccccgggcagcggagagaaccaccaccgggcaccccagccgccgggacagcaggtcccggttcagtttctggccccgccgctccagcaggtccgcccggtttaccgccaccaccatgggaatccccagctccagcagctgggtggtgaggtagaggttgcgctccaggttggtcccgtccaccaggttcagcagggcatcggggcgctgttccaccagaaaccgccgggtcaccacctcctccggggtgtcgggagagagggagtacaccccaggcaggtccacaaaccggacggacgggtcctcccgccagcctccctcccgccgctccaccgtcaccccgggccagttgcccacaaactggttgtccccggtgagggcgttaaaaagggtggtcttgccggcgttggggttgccggccaaggcaatggtcaccatatccagtccctcccctcctcccgccggagctgccggccgggctccaccgtcacctgagcgccgtcagcccgccggagggtcaaggtatacccccgcagccgaagctccaccgggtcccccaaaggcgccgcccggatgatctccaccaccgttcccggcagaacgccaaagtccaacagccgccgtcgggccgccccctgcccgcccacccgggtcaccgtgtaaacttgtcccaccttcccctgatccaaggtcatggcccgcatcctccttttgtgggttgtccctccatcctatgcggacccgcgcggggaaatgacagcaagatcattgcattgtgccattttcgaaaaccacgtattgactttccaatattcatcaactatcatctgaaatagataagatttttgttcgagttgccaaatctatggatctattccaacaaaacccaacgcatggaaaggaggatgaccttctcacatgaaaaaaaccgttgcgggaatcctgatcgctctggttgcctgtctgggctttgccgcgtatttcttcctggcgatcaatccacctgctttatcctatatggaaaccaatctcacagagcaaatcaagcggcaattgaaggaagattctcttctgatttctattcagcgtcctgggacgtggcacgatctatttacgccagaagactggaccttcgttgtccaatatgctgatgcttctaacccccatttttatcagttggacatagacaaagaggaatttgtcgagacttcttcttcccaaaagaatctggcgtaattccaagtctccaatccaaacgcataagacaccccctcctgcgcttttaatgcgcaggagggggttgcttccataatttttatccaatccatattgatccttccgcttttttcttgtacactataaacatagattccaaagagcagaaaggagccaacaccatgaaacgacggaaaaaacggttcgtcctgcccctctgcctgctgcttctgctgtctctctgcgccccggcgtatgcagcagcagacgccccctttgcagacatccacggccactgggccgagtgtcagatgacctgggcccaggaagcagggattcttacagggacctcttccaccaccctctcccccgatgataccgccacccgggccatggcggtgaccgtgctgtaccgttacgccggttctccggcggtggagggtacctccggctttgccgatgtccccgcagacgcctactatgccgacggtgttgcctggtgtgttcaggccggtctcatcacggggaaaacggaaaccgcgttccgccccggggaccccatgacccgagaggaattcgccgcgaccctgtatcgcctcttagtggaccgccacggcgtgccggaacaggtgggggaaaacaatgtcaccaccctggcggattttgccgatgcccagtcggtcagcgcctttgcccaagacgccatggcctgggcggtgggagaccttttcctgtccggtttccgccaggagggagacgcgcgggagctattgccgcaaggccccatcacccggggcgaaatgatccaccttctgcgtcagtatgactgcctggtggagggaaacccggcccagctgtaccgcttctctccggaggacgtgcgctccatccgtcttcagcagggcagcggcctccaggcaatgataacagacccggcggagatccagcggtttttagagaaggtaaacgccttcacgtacaccgtccaggaaaatccccggcctgccggaggcttctacttctttgcggacctccacctgaccgacgggacctcggtttgccttctcctttcccaaaacgggatcgaccatcactacacagagcccgcctcggagggcgatgcgtatttcccattggattggatggagagctttggtctgcgtaaatgacccctcctgggtcccatgcactaaaaaagcccctgccgcggttccttggaacccggcaggggctttgggatgttgctgtggaaccgccgttcattcctcccgggccagctcttggccctggtcagaagcgtcccccacagggtctctctggcccaactgctttttcaaggcgtctaattttgacagtataaggccggtgcagaccgtcacgaggatacagaggaaaagcagcaggccaaccgtcagatcaacccctgcctcgccgctgccgagcagccccacaaacaaacctccggcaaagtagaaccccgccaaggcaacgcccaggccggccagaaggagaagcatccattttttcatcgtccagacctcccattggtaaaaaacggcccctgccgcagtgcggcg

SEQ ID NO: 2259 - DNA, 9555 bp, KLE1738
gtcacggccagcggctttgtctccctggtctacctgatgatccgccaccaccgccgcaacagcggccgggggctggcgcccaccgacgacaagcctgagcgcgccgggcagattctcaagaccctggcggccatcgccattcccatcaccctgagctcctccgtggtgcccatcaccacctacctggacacggtccaggtgcagaacctgctccagagcgccctgggctatacagagcagctggcggtgagtctgtacggctgctaccagaaggccatcaccatctacaatctgccctcggccttcatggtctctctgactgcctgcattgtccccgcagtctccgcggccttgacccggaaggataagctgggggcggggaagattgccgagtccgccctgcgggtgggcgccctgctggccctgccggccggcgtgggcctggcggtgctctccggccccatcatccagatgctctatccagagaccaaccaggaggtggccagccactgcctgctggtgctgggcattgcctcggcctttgtgtgcatgatgctgctgtgcaacgccatcctccaggccaacggccgggcggccctgcctatctggtttatcgccattggcagcgccaccaagctggcggtgaactttgtcctggtgcagattccctcggtgggcatcaagggagcgcccatggggaccctggtgtgtttcgcgctggtgtcggtgatggagctggtggccattaaaaaggttaccccccacccgcccaagtacctgcgggtctttgtgaagcccgccattgccgccggggtgatgggggctgccgtgtgggccagctatggcctgctggccgcccacttgggcaacaccctgtccgtggcggggtccattgtgatcggctgcgtggtctacggcattctggttctggtgctgcggatcgtctcccgggatgacctctccctgatgcccaagggggataagattgcgaaactgctgcggattcgctgagtggaaaaaatttttggaagaagcctgcaaaatatcccataaagacttgagattacgggaatgatatgataaattatgatcaattttgaagagaagacggcctatacggtggaggacctgcgccggattgtccacctgctccgcgccccagggggatgcccctgggacggggcgcagacccatgagagcatccggcgcaacttcctggaggaggcctatgaggtggccgaggccatcgacgagaaaaaccccgcccatctgaaggaggagctgggggatgtcctgctccaggtcctgtttcatgcctccatagaggaggatgccggccggtttaccctggacgacgtggccgacggcatctgcaaaaagctgattttccggcatccccacgtctttggcggcgcggcggccaccccggacagctgggaggagctcaaacgccaggagaaggggcagaccacctacacagccaccctccagagcgtggccaagagcctgcccggcctgtggcgggcggagaaaatccaggccaaggcggagaaagcgggctttgaatggcccaatgtccaggccgccatggacaagctcaccgaggagctggaggagctccagaccgcggtggcggaccacagcaacgtggaggaagagctgggcgacctgctgtttgccgcagtgaagattgcccggttctttcaaatagatgccgaggacgccctggccgggacctgcgagaaattcattcgccggtttgccggggtggaggcggcggtcacagcccagggcagggacatgagggagttggatgtgtcccagctgatggcgctgtggaaccgggagaaacacccggaaaacgaagagagaaagggtaatcaccatgaacaagactgaactgatcctgcgcatcgcggaggagaccggcttctcccggaagaatgtggagctcggcctgaacgccgccatcaacctgatcaccaaggcgctgacagaggaggaaaaggtccagatcgttggcttcggcgccttcgagaccaaggtccgcgccgagcggatgggccgcaaccccaagaccggggaggacatccccatccccgccaccaaggtgcccgtctttaaggccgggaaagccctgaaggacgcggtggatcaataatccccacccacaagacaaccccgccctggagccatgttccagggcggggtttttggcgctggcaggaaaagaaaccggatgggttcctggtctcacaggaacccatccgctgaaaatcaaagttctttgtagaggagcacggcattctccttgcccttgggctcggtgacggagagaacctccagccgcaccgtccgggcgccgaagcggatctccagctgatcccccaccttgacctcataggaggccttcaccacccggccattggcggagatgcgctcgttgtcacaggcctcgttggccacagtgcggcgcttaatcaggcgggagaccttcagccatttgtccagtcgcacggtctcacctccttattccaccaggccgatgtgctggaaggggagaaccgtgcagatggcccgccccagcacataccgggtgtccaccgggcccaggcggctgtcccggctgtcggaggagttattgcggttgtcccccatgacgaagacagacccctcgggcacctcccagtaggtcccctgcaggtaggggctctccgggcggaccatgggctccatgatgtagtcctcctccaggggctgaccgtccacgtagactgtgccggtgtcatagtcgatttccaccgtctggccgcccacggcgatcacccgcttgacaatgggggtttcaacgtctccaaagtccttgtgcaggaccaccacatccccctgcttgggctcataggcgatgcactggagaaagagcatgtcccggtcgttgagggtggggtccatggagtggccgtccacgccgatcacgcggccgaagaaggtgaagaagatcaagataaaggccagggcaaaggtgagggcctggagccagccgtagaggtcggcgccgaaagcccccggcttcttctctttgcccgccttctgggcggccgtatcctccgcggggggcgcggggttctgggatgcggccggtccctcctggggcggcgcctcggaagacaggtggggctcctccggcgggagatgggattgggacattatgggaacctccttttggaacggaacaatttcagggtcagtcctctattatacgcttctttttccgggatggcaaccatagattgccgccgccggaacccaccgtccaggatgcccgttaaaagtcaggcagtgtcaccgtggtgatctccggccggtcctccagcatgaagaattcccggtgctggcaggtgaacagcaggatctgacggtcctcggccagctctgtgagcaggtgcaggaccaccgccagacggtcatcgtcaaaggacagcagcgcgtcgtccaggataagcggacaggcctggggagaggggaggaccaggtccgccaccgccagacggagggccaggtagagctggtcggcggtgccttggctcaggagcgccagggggcggtcggccagggcgccggtctcccggacggtgacgttgaaactgcggtccagggccacctgagagaaccttccctgggtcagctgctggaagtatccggcggctgtctggctcagctggggggagaaccgggcgtggagctgatcgtcggcctcctttagggcctccatggccacctcaatggcgtcgtaatccccctgcagccgggcggaggcctcctgaatctcgtccagccgggcatccaccaggaccgggtcccccagggcggtgagctgaccttggatctgggcgatctcctgctctgcctggtgcagggaggcccggcaggcctccgcctccggggggagataggggccgctgccgctctgctggctgacagcctcgaagtatttttgggcgtgctcccggcggatttgggcctcccgcaggtcctgggccaggtggctgtcctcctgctggcgggtctccagcagggcgcgaagctcgtccagggccttggtgtcccgccggtcacaggcggacttaatcaaggtgaacagcagcaccagcagccagagtacccccaccacaggggccagaaacaggaggggaatctccgggagctggagggggaactggggcacatggggcgctgcgaacagcaccaccccgcagagggtcagcagcacgatgagggtcacaaagcctgtcataagccgccgccggctggccagatcgtccagggtgtcttgaatctcctcctccagctcgtcggggtccggctctgtctggggggcgtcggcctgctggcgggccaggagggtctgtaactggagttccgctgcgtccagctctgcggcggcctctgcgtagcgccgctggctgatggtctggaatttgtcgttttccatggacagccggctctcccaatgggccttctgctggcgcaggccggcggcccgggcctggagctgggccagatcctggcgcagggaggcggtctgggtgagggtctgctggagctgggcctcctccgcctccagctgggggatcaggccgcttttgtggaaccggcggcggtggagccaggtcttgaggcgttcgttggcctcggtccaggatacatcctcctccccggaggagaccagggcggtgatccgcttctccagctcctggctctggctgacggccaggccagtctggcggaagaacaccgagcggtcaaagacctcctggctcacgccagtgaggatctccccggcggtctccccggtcaggccgggcacggccaggccggtgtcctggtagaccgcggaaaaatcccccatgggcaccccgctggcggaggtccggcggagctccaggacccggccctggaattcacagaccagcagcccctccatgggggagccgctccagggccggtaacggtttttgtcggcgggggcgcccttgcggtcccgctggcgggtgtccaggccgtagagcatggtccgcaggaaggcgcaccaggtggatttcccgctgccgttgggggccccgatgagggtcatccccgggccgaattccagggtgtccccctgtaagcagccgaaggtggcggtgagctgcaagagtttcattggggctcctcccttccttccagggcggccaggccgaaccggaccgcccgttccagcaggggccgctcagagggggcggcctcctggaggcgctgggccatggcccggaggaagagcccggtgagggtatcctcctccatccgggcccagagagcctggctcagggtggtgttgtcatagagactggcgctgtaaaaatagccggaggccagggcggtgagggcagtgagattgggctcgttgtccgggtcccgggtgccggtgagggaaatccgaaggatgtcctccggccgggaggcgcggatgagcgcctccagcgcctgggcggggtcctggccggtgatgtccaggctgggggtgaggtaccgccgccgggccagggggacaaagtccagggacacccggccgccctccagctggcccagatagacccctttgtccccggtctcgtcaaagccccgcccctccgggcagccgggccaggcgtaataggtttttcccgcccgcttcaggccgctggcgctgtggctgtggcccagggccagatagtgcaggcccgaggcggcaatttcattgtgggtgatggggccgtagcggctgtgggcggaggagaggtccccatgaaagcagccgaaagcggccaggtcctcctcctgggcgtggaagccggccagggggctgtccatccggtagagggaggtaaaggcactgccgtagaccaccgcccccaactggggcacctccacccgggccggggcggcctgggtgaagatatgtacgtggtccggccagggaaactttccgtagggggaggtgggggagtaggggtcgtggttgccgggggagagaaagacctctgcctccagctcctccaagacctgatagagggcctggactgtttccggccgggcccgctggccgtcaaaaaggtcccccgccagaaagaccaggtcaacctgtgcctggcgggcggtgtccgccaggcgggtgagcagctggcgctgctcctgccggcgttccgccgcctgttccggggggagggcatgaaagggggagtccagatgaaaatcagcggcgtggagaaaggtcagcatgcacaagccctccttgggtcccgtcagtctgtcaggtcggtgcgggtgacctggcagcagcgtttggtctgggtgtcaatggtgaagagaacggcccccagccggttggggccgtctgcggcctcataccgccggggcagctggcccaggaagcgggccacggagttttcgggttttacccccagaatggaccgggcagggccggtcatccccaggtcggtgataaaccctgtgccctggggcaggatctgcgcgtcggcggtggggacatgggtgtgggtgccccacaccgcctgcacccgtccgtccaggtaccaggccatggcccccttttcgctggtggcctccgcgtggaagtccacgaaaagcagatcggcctgggcgccctccccggccagaatctcgtcagcccggcggaagggggagtccaggttggcgtccagctgaaaccgtcccatcaggttcagcacccccagccgcaggccctgggggccctcatagagcccaaagccccgcccgggaaggttgggggcgaagttggccgggcggagaatataggggttgtcctccagatagtccgcgatctgccgttttccccaggtgtggttgcccagggtgatgacgtccgcccccgcgtcaaagagttcctcggcatgctggggcagcaggcccagaccggcggcgttttcgccgttgaccacggtgaagtgaacatcgtgttcctttttcaaccggcgcaggtgccggtgcagacagtccagcccgccctgggccaccacatcgcccacagccaagaggtgaagcagcataccgtctccccctttttcaaacagaaaagatttcccttattatatgctattttggggaaaacaaaaagggagaaactgcaaaaaaagacaaaaattttggcggggcgccgtgtagaaaaccccgcccctgggagcttcccaagggcggggcgtactatgggatgtaggaatcacttggcgtattccacgattttgacctcccgcagcagatgaaccttgatctgtccgggatactccagttcgttttcaatccgctgggcgatctcccgggccagcaaggtcatttcatcctcgctgaccacttcgggcttgacgatgatgcggacctcgcggccagcctgaatggcgtaggatttctctaccccgcggaaggaagaggtgacctcctccagtttttccaggcgcttgatgtagttttccaggttttcccgccgggcgccgggtcgggcggcggaaatggcgtcagcggcctgcaccaggcaggcgatgacggtctggggctctacgtcgttgtggtgggcgtggatggcatggaccacctctttgctctccttgtacttccgggccagctccacgccgatggtgacgtgggagccctccacctcgtggtccacagccttgcccaggtcgtggagcaggccggcccgcttggcggtggccacatcctccccaatctcggcggccataaggccggccagctgggccacttcgatggagtggttgtacacgttttgtccgtagctggtgcggtacttcatgcggccgatgagcttgatgagctcggggtgcaggcccatgacgttggtctccagcacggcgcgctcgccctcggccttgatggtggcgtccacctcccgcttggcgatttccaccatctcctcaatgcgggcggggtggattcggccgtccaggatgagcttttccagggccagccgggcgatctcccggcgaactggatcgaagcaggagacggtgatggcctccggggtgtcgtcgatgatgaggtccacgccggtgagggtctccagggtgcggatattccggccctcccggccgatgatccggcccttcatctcgtcgttgggcaggggcaccacggacacggtggcctcggccacgtggtctgcggcacatcgctggatggccagccccacgatctccttggctttcgcgtcggcctcctccttgaagcgggcctccacttctttgattttcatggcggcctcgtgggtgacctcggtctccagcttggcgatcaggtaggctttggcctcctcggcggtgtagccggagatccgttccagagtctccatctgctcggcctggagcttggcgaccttggtccgggcctcctccaggttggccaggcgggcggcgtaggactcctccttccgctccacgttttccagcttgcgctccagggtctcttccttctgctggagccggcgttcctgctcctgcagttcggagcggcgctccttggcttctctctcgtagttggttttttccgccagaattttttccttggcttctaccagggcttcccgttttttgctctcggcgctcttgatggcctcgttgatgatgcgcttggcctcttcctcggcgctgaggatttccttttccgccactttcttgcggtacaggatgcccaggggaatccctatcacaagcgcgacaataaatacgatcacgccggtcaggatatagggcagcatattgtcgggacacacctccatttctctaaaatttcgcataaaatcgcggcagccgggccgaaccgggccgatggcggcgccgcagaaagcgggcatgaggtcccggagtcccgcccaagaggggagactgcctcattgtctgcatatttatactgattttattttaatgggcaaaggcgcgtctgtcaagagacttcgggggcaccgccgggaaaaacttccgggaaaggctgtccggacggacagaatgggccggcagggcataggatgggaaaacagaaaaggaggaattgccatggaaggagctatgcctaacacccccctggaccgggaagaggacaaaaaggaaatctttgcccgggtctggaagcgcgtcatgggcgaccacaccgatgcctgccccatcacctgggaggagacagggggagaccaggcccagaccacaaccgagcagcagcagaccctggtcaccgaggaggcggcccagacggaggagaagacggtgctcccggccccccatgttccccgaggcggccagcggctccacagcgactttccccgggacgatgcccagggggttttggggccccagtgtctggactgcgcgccgctgctccaggagctgatccgccgggagctggccgactgccgggagtaccagaccctctcccgccgggccgggggcggccccgcccgggtgctggcggggctggctggagagaagaagcgcc

SEQ ID NO: 2260 - DNA, 8344 bp, KLE1738
tttgccaagctgggcagcgactacaaaaagcccgacgccaccacggtcatttcccgggaacaggtgccccagattctctggcccctgccggtgacggacctgctctttgtggggcgggcctccgcccggatgctggcggagcaccacatccataccattggggacctggcccgcgcccgccgggaggacctgaagaaatggctgggcaaacacggggagcagctccacgacgcggccaacggctgggaccacagccttgtccgcccggcgggagagaccccgcctcccaagtccgtgggaaacggcctcaccttccgccggaatttgacgggagcggaggagatccaggcgggggcccagctgttggcggaacgggtggccctgcggctgcggcggcatcagctcaagtgtaccacggtgcaggtgtccctgcgcagcccggagtttaagaccatccaacgccaaaaggggacccccgcccccaccaatgtctcccgggtgatcttccagtgcgtggtggagctgctggaggggacctggaactggtcggcccccctgcgggccatgaccatcaccgccgccggactggtgccggaggaggaggcgggggagcagctggacctcttcaccccccaggccgctgtgcggcggggcaaacaggagaagctggagcggaccatggatgccctccgggaccgatatggcccccatgtcatcggctacgcctcccggcagacccagaccgcccgggagatcgccggggacgagaccggaaaacgaaaggaggaatccccatgagcgccggtgtactgctgtggattttgggctggaacgtggccgccttctgccttatgggcgtggacaagtggaaggccaaacacggcagatggcgtctgccggagaaggttctctttctgtccgccctggccggggggagcgtgggcgccctgctgggtatgggctttttccgccacaagacccgccactggacctttcgcctggggatgccggccattctgatcctgcaagtggcggccctgacggcctggacatactgggatgttttcctccgatagggggagggcctgccccggggggacaaagtgcccaagcacagcccctcccggcggtgatcttcccacagagtcactacttgacgggaggaagaaattgtgctaaaatccgagattgcgatgaactatttttgacgggcaaaatccgtcggaatgggaagcatggggccggttcgagacggcctggaaaggggagagaccgcgcgatgctgaccgatctgaagtctgccaaaaaggtgacgggggccaagcaggtcacccgtgccctgaaaaacgggacggcccgccgggtctttctggcccaagacgccgacccccgggtgacagaacccatcgagcttctctgccgggagcagggaaccgagaccgaggccgtggcaaccatggccgccctgggcagtgcctgcggcatcgctgtgggcagcgcggtggccgccgtggtggactgacccagacttttttcgatattcgccgcataggctttgtcctgggcggttagaatataaatccattgtaatttttgagaaaggaggaaccacatgcctacgtttaatcagctggttcgcaagggaagagaacaggcgacctacaagtccaactctcctgccatgcagaagggcctgaacaccctgaagaacaaggagaccgacctgccctccccccagaagagaggggtgtgcaccgccgttcgtacctctacccccaagaagcccaactccgcactgcggaagatcgcccgtgtgcgtctgaccaatggctatgaggtgaccgcttacatccccggtgtgggccacaacctgcaggagcactctgtggtcatgatccgcggcggccgtgtcaaggacctgcccggtgtgcgttaccacatcatccgcggcagcctggatacccagggggtcaacggccggatgcaggcccgctccaagtacggcgccaagagacccaaggccggcaagaagtaaggagcccgggaagcacattttttgactgattttttgcgctcagcgcaaagcaaaggctttgccgtgagtcgcttaccatagaaatccggtacatggtacagggtttggggaagctctcaaggcaggcacgggacaaggtctgcttgtcccacacggaaagcagcggcttttcgagtacctatgaaatcatttttttatgaaggagggaagcaaagtgcccagaagaggaaacgtacccaagcgggaagtgttgcccgatcctatgtaccgttccgtactggtaactaagctgatcaacagcattatgctcgacggcaagaaaggcgtggcacagaaagtggtttacagcgcctttgacattgtcaaggagcagaccggcaaggatcccctggaggtcttcaccgccgccatggagaacatcatgccgtccctggaggtcaaggcccgccgtgtgggcggcgccacctatcaggtgcccatggaagtgcgcccggagcgccgccagaccctcggcctgcgctggctgaccacctatgcccgcaagcgcagcgaacggaccatgaaggagcgtctggccgcagagctgatggacgccgccaacaaccttggcagcgccgtgaagaagcgggaagaggtccataagatggccgagtccaacaaggcattcgcacacttccgctggtaatctggaggaaaaagaagaatggcacgtaaagttactctggaaaacaccagaaacatcggcatcatggcccacatcgacgccggaaaaaccaccaccaccgagcgaatcctgtattacaccggcgtcaactataagatcggtgagacccatgacggcaccgccaccatggactggatggcccaggaacaggagcggggcatcaccatcacctccgccgccaccacctgctactggaccggcaccgccggccagttcccccagacccggatcaacatcattgacaccccgggccacgtggacttcaccgtggaggtggagcgttccctgcgggtgctggacggttctgtcaccgtcatgtgcgccaagggcggcgtggagccccagtctgagacagtgtggcgccaggccgaccactataaggtcccccgcatgatctacgtcaacaagatggacatcatgggcgcggacttctacaacgttttgaacatgattcatgaccgcctcaagtgcaacgcggtgcccatccagctgcccatcggcagcgaggagaccttcaagggcatcattgacctggtggaaatgaaggccgacgtctattacgacgccgagggcaaggacatgcgggtggaggagatccccgaggacatgatggacctggcccaggagtaccggaccaagctcatcgacgcctgcgccgacctggacgaggagctcatgatgctggccctggaggatgagcccatccccgcggacatgatccgggccgccctgcgcaagggcaccattgagaacctgctggtccccgtgacctgcggcacctcctaccggaacaagggggtccagaagctcctggacgccatcgtggactacatgccctcccccctggacatccccgccatcaagggcgtgaaccccgacaccggcgacgaggacgagcgtcccgccgacgacaaggcccccttctccgccctggcctttaagattgccgccgacccctatgtgggccgtctgtcctttatccgcgtgtactccggcgtgctgaacaccggcacctccgtgctcaactccaccaagcggcagagagagcgcatcggccggattctgcagatgcacgccaaccaccgggaggacattgagaccgtctactccggcgacatcgccgccgtggtgggtctgaagaactccaccaccggcgacaccctgtgcgacgacaaggcccccatcattctggagtccatggagttccccgagcccgtcatccgggtggccatcgagcccaagaccaaggccggccaggaaaagatgggcgtggccctcatgaagctggccgaggaggaccccaccttcaagacctacaccgacgaggagaccggccagaccatcatcgccggcatgggcgagctccacctggagatcatcgtggaccgtctgctccgggagtacaaggtggaggccaacgtgggcgcaccccaggtggcctacaaggagaccatcaagaagtcggtggagcaggacaccaagtatgcccggcagtccggcggtaagggccagtacggtcacgtgaagatccgtgtggagcccaacgagtccggcaagggctatgagttcgtcaacgagatcgtgggcggcgccatccccaaggagtatatccccgccgtggacgccggcattcagggcgccatggaggccggtattctggccggctaccccgtggtggacgtgaaggtcactctgtacgacggctccttccacgaggtggactcctccgagatggcctttaagatcgccggttccatggccttcaaggaggcctgccggaaggccaacgcctgcctgctggagcccatcatgaaggtctccgtcatcgtccccgaggactacatgggcgatgtcatcggcgatttgaactcccgccgcggacagatccagggcatggaggcccgccccggcgcccagcagatcgacgcgctggttcccctgtccgagatgttcggctacgccaccgacctgcgcagccgaacccagggccgcggccagtactccatggagccccacagctatgtggagattcccaagtccatcaccgacaagattgtcgagaagcgcaacggcgcggaataactggaattttcttggaattgtgcaagaaatccggattttcccgttgtaatttcaagggatatcctgtaaaataggactacctgaaatcgcatgatcagtaaaacagccttttgtctgtattttgaggaggattatcaatcatggccaagcaaaagtttgaaagaaccaagccccacgtaaacatcggtaccatcggtcacgttgaccatggtaagaccaccctgaccgctgccatcaccaagtacctggccctgcagggcaaggctcagttcgaggattattccagcatcgacaaggcccccgaggagagagagcgcggcatcaccatcaacaccgctcacgtggagtatgagaccgacgtccgtcactatgcccacgttgactgcccgggccacgccgactatatcaagaacatgatcaccggtgctgcccagatggacggcgcgatcctggtcatcgccgccaccgacggccccatggcccagacccgtgagcacatcctgctggcccgtcaggtgggcgtgcccgccatcgtcgtcttcctgaacaaggttgacctgctggacgacgaggagctgctggagctggtggagatggaagtccgcgagctgctgagcaagtatgagttccccggcgatgacctgcccgtcatcaagggttccgctctgaacgccctgacctgcgagtccgacgaccccaacgcccctgactatgcctgcatcaaggagctcatggacgctgttgacagctacatccccacacctccccgtgatgactcgctgcccttcctgatgcccgtggaggacgtgttcaccatcaccggccgtggcaccgtggccaccggcagagtggagcgtggccagatcaagatgggcgacgccgtggagatcgtcggcctggccgaggagagcaagaagtccgtcatcaccggcatcgagatgttccgcaagctgctggactatgctgaggccggcgacaacgtgggcaccctgctgcgtggtatcgacaagaaggagatcgagagaggccaggttctggctaagcccggctccatcaagccccacaccaagttctctggccaggtgtacgtcctgtccaaggacgagggcggccgtcatacccccttcttcaacaactatcgtcctcagttctacttccgtaccaccgacgtgaccggcgtcatctccctgcccgagggcgttgagatgtgcatgcccggcgacaacgtggtcatgaacgtggagctgatcacccccatcgccattgagaagggcctgcgcttcgctatccgtgagggtggccgtaccgtgggttccggcgttgttaccgagaccgctgagtaagtttctcacgtttttcagaagggcaaagcctctgctttgcccttctgtttttttctatggagccattgttccacgtgctgagaggaggcggagacatgagtacaagcaccattgacacagaaaccctggagaacagcgtgcagaccggggtgaaccagctgctgcgggggggctggggggaggccctgaagaccatcctatttgcccttttgctgctggtcatctgtctggtgatcaaggccattttgctcaaactgctggaccggggattgaaccgcttcagccaggtggagaagagcctgcacaccttcatccggtccatggccaatatcctgctgtggtttattaccctcatggtggtggcggattccctgggcatcaacgccagctccctgctggccctggtgagcattctgggtctggcggtctccctgtcggtgaaggacagcttgtccaacctggccgggggactgaccatcctggggacgaaaccctttaaggtgggggactatgtggagattggagagacaggggggacggtgcaggagatcggcctggtgtacaccaagctgaccaccattgacaaccggcgcatcctgatgcccaacagccttgtggtggatgcccaggtgaccaactacaccacggagcccctgcgccgggtggatctgacggtgtcggcctcctatgacgcgccggtggagaaggtgaagcagaccatccagggggtgctgaaggatcacgacaaaatcctgctggacccgcccccctttgcccgtctgtctgggtatggggacagcgccatggagtataccatccgggtctggtgcgagaacggggactactggacggtgtaccacgacctgctggaggagatcaaaaccgcctttgaccgggagcacatctccatcccctatccccacctggaggtcaaacttcaccagtcctgagggaccagaccgggggcgcagaggcgttgccttttggtggaagatatgctatcatgggcctgttttcaaaagaggagggcgaaggatgaccttttatcaggaactgcagctcaatcaggcgggctccaagctgatgatccaggaggcggtgggaaggcgggccaaggcctggcacctgctggtatatctggtgaagattctgctgaccatggtgttctgtgtggcctttgtcaccctgtacggctgggtgtttggggcggagaacaacattgtgggcgtggtggttctgctctgcctgatggtgttccggcaggcggacctgggcatgcggcggggccagagcctgctggccctgggtcttgtgtttctggtgctggcctttggcccccggctggccaacctggcggagctgggcggggaactggctgtccatggcctgagtctgctggtgatcctggtgctgggctgccacaatgtggggatggggaaccatctgaccctggtgctggggtatctgctgctgtatggctatgacgtggaggcggcggcatttcccagccggctggcggccctggcagtgggctgcggcctgaccctgctggtctatgcccggaaccacagagcggacccctattgggagggcattcccgccgtgctccgcgcctggagcttgggggaggcgcgcagccgctggcagctgaaggcggccttcggggtggccacggccctggtgctggcccatggtctgggctttccccggcccatgtggatggggattgccgccatgtcggtgttgctgcccagccggcaggccattcccggccgggtgaagggacggatctggggcaacctggcggggggcgcgggcttttgcctgctgtactgcctgctgccgggcagtctgctgccctatctggggattttcggcggcattggcgtgggcctttcggccacctatggctggcaggcggtgtttaactccctgggcgccatgtccatcatggtgggaaccctgggcctgcccggcgtggtgctcttccgggtgggcaacaacgccctgggcgccctatacgcctgggccgtggaccggctggccggccccgcctggcgggtgctgcggcgcgccgccagctgaatgcggtgcagaaacgccgcccaccgtgggataacggcgggcggcgttgtctttgtttgcgggggggacccgttc

SEQ ID NO: 2261 - DNA, 7948 bp, KLE1738
cgcctactggcggggggactccaaccgccagaccctccagcggatctacggcatcgccttccccaagaaggacgaactggacgaatatctggcccggattgaggaggccaaaaagcgggaccaccggaagctgggcaaggagctgggcctgttcatgatgaccgaggagggccccggcttccccttcttcctgcccaaggggatgaccctgaaaaacactctgctggaatactggcgggaatgccacaagcggtatggctacgtggaaatctccacccccatcatcctcaaccaggacctgtggcaccgctcgggccactgggaccactacaaggacaacatgtacaccaccgtcatcgacggggaggactacgccgtcaagcccatgaactgccccggcggcatgctggtgtataagaatgagccccactcctaccgggacctccccctccgcatggccgagctgggtctggtccaccggcacgagatgtccggcgccctccacggcctgttccgggtgcgctgcttcacccaggacgacgcccacatcttcatgacccccgaccagatgaaggaggagatcaagggcgtggtgcggatctttgacgagatctactccaccttcggcctgacctaccagattgagctgtccaccatgcccgaggaccacatgggcgaggagaaggtgtggcagtttgccgaggagaccctccaggccgccatccaggagatgggcaaggactttatcctgaaccccggcgacggggccttctacgggcccaagctggacttccacctggccgactctttgggccggacctggcagtgcggcaccattcagctggacttccagatgccggagcggtttgaactggaatacgtgggcgaggacggggagaagcaccgcccggtgatgatccaccgtgccctgctgggctccattgagcggttcatcggggtgatcaccgagcactttgccggggccttccccacctggctctccccggtccaggtgaaggtcctgcccatcaccgaccgggctgcggcctatgccgaccaggtggccgcccagctggatcaggctggctaccgggtggaggtggaccaccgcaacgagaagatcggcaagaagatccgggaggcccagctggagaaaatcccctatatgctggtggtgggcgacaaggaggccgagtccggccaggtggccgtccgtgcccgctccaagggggacctgggcgccatggattttgccgccttcctggcccacctgaagcaggtggtggacgagaagcagatggaccaggccctgtaatcccccggccatggacaagcaagcagagcatgtccgggaccggctcatcgtccgaaccagcctggtggccattgggaccaacctctgtctggtggccttcaaaatggcggtgggcctgctggccaactccatcgccatcgtcctggacgccatgaacaacctcagcgacgccctgtcctccgtcatcaccattctgggcaccaagctggcgggccggccgccggacaaaaagcaccccttcggctatggccggatggagtatctcaccgggattctcatcgcggggatcattctgtttgccggggtaaatttcgctgtgacctcggtacagaagatcatcaccccagacctcccccactactccctgctgactgtggggatcgtcgccgtagccattgtcaccaaactgctgctgggcgcctataccaaaaaaatgggccgaaagaccggctccgacgccctggtggcctcagggaccgacgccacctttgatgcggtgatttccgctggcaccttggtcggcgccctggtcaccttgaccagcggttacgtcatcgatggctggatcggctgtgtaatctccctggttatcctcaaggccggcctggagctgctgctggacaccttgagcagcatcgtgggccgccgggcggacagccagctcagccaggagatcaagcagcgtctgtgcaccgtggacggcatcctgggagcctacgacctggtgctacacaactatggccccacccgggccatgggctcagtgaatgtggctgtctgggactggcggaccgcagcggagctccacaccctgagcaaacaggcccaggctctcatttgggcagaataccacattttcctctacatcggtttctatgcggtaaacacccaagacaacgccctccgggcgttggaagatcagatccgcacagaatgtcaggcctatccccaggttctctccatccatgccttttttgaggagaaggaaaccggaaccatttccttcgacgcagtcattgacttctcctgccgggacagcttggggctggtgcggcaaatcgaagcggacttagcccagaaacatcccggccgccagttcaccatcaaggtggatcgggcttacagtgattaatcccataggaacaggagacatgctatgtttttggaaaccaccccagagagaaaaatctataaggaactggccgcggaccactttgccgaccccaaagggctgggaaagtacgccctctttctccgtccctcccagggcgacctgatccccgccccccagatggagcccagcctgctcctctccggccggtaccggcccatcaccctggagggacgcaacctctttgccacccgggacttctacgcctttttcaagcacctggaggagacgggcattgaggccacccacaagggggtggtggtgatcgccatgaacaagctgcgggaggtcatgctggagacccccgaggtactggacaatgcccgcctcaccgccgacggcaggaatctctatctgatcaaaaacaagagtacgaacatcggataaaaaacaacaaggcccgctccccttggggagcgggccttgtctgtctcactgggataccgatccggcgggcagagacggaaccggtctcataaccgtggagggatgcctgctcaaaaaggccgcataccgtatggaatgagcgatcaggtccctcccggcacgaatcgtcacccatgactgccccggccgggcttcctgtacggtaaaaccccccgccattctcatttcttccagcgtaaatgccaactgttctcttgttatttggaccgcagggtcataccttataacgtaacatcttatgccgtactgcgccgcttccctttggatggcagcttcatactcctcaatagaaatgatttcggttgcagccggggccgcagccgacgccgtcagaggcatccacaggcaaaggcctgccataaacagggtgaagaaaaaagctctcatcgttcccctcctattctcatggaacacgcccatccgctgctgtggtttgtccccacaaaagagagcggtgcttcgctcctgcgccatggaaacggtggctccccctcttcctctcatttttgccggagatacttgatacatgcggcaatgaccaaaactaccataacggccttcaaaatgccacccagagtacttactatcaccataaacatatccgtacctcctttccagcgcggcagcacatttcgcactggccgctgtccatgtgggggttcttttttatagtatagctgtacttgagtgcatctgtcaattcccacaaaataaaaatccatttctattttttattgtgcatataattcatttccatcggtgagcccgtcaccaccacatccacccccaggccgaaggggtcctggagggcggtctgccccactgagagggaggcggcggggaggatgcagtggcggagggtctccatgcaggccagcagacggtccctgggcacgccgccgctggttttcaccgggatcagccgcccatccgcccctttcagggtggtggtgagcacccgccgggggtccacggcctcctggcgggcatagtcggcccccttggggcagccgtttccccgggcgccctctccggcatgccaggtcacctgacagcccttggggcagaggatgcaggtggtcacccccggctggggcaggcccttggccatggcgttggccgtctccgggggcatgggggccaggggctctccccggacaaaccgggcggcgttggccccggcggcctggccctggacggtgacaaaatccgccaggtccatcacccgccggctgttgccgcaggcaaagatgcccggcacactggtctggagaaagggatcggtcaccgccccattggtcaccgggtccaaggcaatgcccgcctgggcccccacctcgttttctggaatgaggcccaccgagagcagcagggtgtcacagtccacccgccgttccgtgcccgggcacaggcggccctgttcgtccacctggcacagcaccaccccttccagccggccccggccaacgatctccgtcaccgtgcaccggagaagcagcgggatgccaaagtcgtccaggcactggcgcacgttgcgcgccagcccgccgggggcgggccgctgttccgccacgcacaggaccttggccccctccagggtcatccgccgggccatgatgagaccgatgtccccggagcccaggaccaccacccgccggcccaccagaagattcttggtgttcataagattctgggctgtccccgccgtatacacccccgccggccgggtgccggggatggcgatggccccccgggtacgctcccggcagccagtggccagcaccaccgcccccgcctggcaggtcagaagcccccgtcgggtaactgccgtgagggttcggtcccgggtcagtcctgtgaccatggctccggtcatcaggtccgccccggcagaccgggcctcctcccgggcccgctgggcatactccggcccggtgagggcctcccggtaccgcaccaggccaaagccgtcgtggacgcactggttgagaatgccccccagccggttctcccgctccagcaccagaaccgaggcggcccccgccagccgggcgccctgggccgcggccaagccgccgggaccgccccccaccaccaccacgtcataccgaatggcctccatcatttcaccctccctgcaaacaggggggacccttccccccggtaggtcacatcttccggcgccaggccgtagtcctccaccagcatctgggcaattttgggcaggcagtagcccccctggcaccggccggtggtggcccaggcccggtacttgattcccgccagggttctcacccccaaggggttttccaccgcctggcgaagctccgcccgggtgacggtctggcaccggcagaccacctccccatagtccgggtcagcggcgatgagggcggcctgcgccgccgggctctggtcccgaaaccgccggatgccccggcgatgggcctgaaagtccgcccggggggacaggtccagggaccctcccaccagcgccgccacccgccgggcgatgggaagcgaagcggtgagccccggggactcaatgcccaccaagttgacaaatcccggcttgtcctcccggatcacaaagtcccggtagcccccctcccccggcggggccagcttgggccgcagaccggcgtaggccccgatgatctgccctttctccagggcgggcagcagctgccgggcctggagaaagagctggtccatcaccggccgggtggaggccgtgtcctcggggctttggatatactcggcgctggggccgatgagaaggttcccgtggatggtgggggtcagatggacccccaatccccccgcccccgccttgggggcggggtagacgggcaggggcagcaggtcccctgcaatctggtccaggatgaaatactccccccggcagggatagatgcgatacccctccacccccgccagggcggcgatccggtcactgaacagcccggcggcgttgaccaccacccgggccgagaaggtctctctccccgccgtcacaacatagccgccctgggaaccgggggcgatggcagtcaccgggtgccggaaaaagaaatggaccccgttggccaccgcgttctccgccagggccaccgtatagagaaaggggtcgaaaatccccgtctccggagagaccatggccccgatgccccccacctgggggaggaacgcccccagctgggcctggtccagcagatgcagtccccggcagccgttggcctccccctgggccaggagacggcggagcaccgccaggtcctcctggtcaaaggccaccaggagttttcccgtcttgcggtacggaacctccagctggcggcacagcgccgcaaagccctggtttccctccacacacagctgggccatgaggctcccagggcggttgttgaagccggcgtggaccacggcggagttgcggccgctggttccggcggccacgtcggcctccttctccaccagggccaccgaccgctgggaacgggacagctcccgggcaacggcacagcccacggcgccgccgccgatgatgaggatatcataggttctgtttgactggtccaagatggtctcccccttttgttgggtttatcatagcatatcatggagaggcccacaagggggccggctggcgccgttggaacgggcgggaacggggccctcccatttgtaggggtacctccacgccgttggaacggcggggaacggtggcttcccagccggggccctatttctttgaagaaataggggaaagaacaccaaggggaaggaggttccttccccttggaaccccattctctggtgggaggaacgggggaaagtggttccgtcaggttggggcctggcctgcggcctctaaaaccaacgcctcatggcccgcccaccggctcgggcgggcgggagaagtggtttattggcggcaggaaaaaatggaaaatcgaacggttactctccgccttctcccaaagggtacccacccacgtcccccgcccgcccagccggtgggcgggccgttacggacctttcactgtgagggccgcaggccaggtattccataagaagtacagcctccccccacacaaccccaccagagaagggagtccagagggaagaacctcttccctctggggttctttcccccatttcttcccaagaaatggggccccggctgggcaagccaaggttccctgccgtttcaacggcgtaggagaaaccccgcaacgcgccccgcccgttccaacggcgcaggggcaaaacacaaaaaaccagccgctcccgtccccgggaaccgctggttttctttgcgttctggcctctctcactccgccaagctctgcacagacccctgccggcagtccatggagaccttcatcccgtcgtgcagggtccgggtggctccaatggcccccacaatgaccgccttgttcaggctcagacccaccaccgcggcgtggctgcccagcccattctcctcggtgatgattccggcagcctgccggagatagggcagcatgtcgttgttggtatggggcaccaccaggatcattccggggcgaaacttgagcttcacatcctccaccgtgcggcagacgcagaggacccccttgacgttctcatcccctaccccggcaccgctgatgaggctgctgcccaccagatggaccttgatcatattggtggtcccggcgatgccggcgggcacgccggcggtgaccacggcgatctccccatcgtggatgaggccggcggcctgggccacggccacagagccctcgatcatctcgtcggtgctctggacgtagggcatgatgaggggccggaccccccaggtgagggagagctgccgctgcaccggctcgtccataacgcaggcgatgatgggggtctccggccggaaccggctgatgagccggggggtggccccgcttttggtgacggtgatgatggccgaggcgttggtgtcggtggcggtggtgcaggcggcatgggcggtggcc

SEQ ID NO: 2262 - DNA, 7237 bp, KLE1738
cccagcttggtcagggcctccagcacctgggagaccgccgtgggcaccatgtccgagtggccctgggcatagccccggtaggccgacatggtacacacaaagaagcaggacagcgccatcacccgcacagcgggggcggccagactgtccccctggagattggccaggggctgggcaaagacaaacatcaccaggctgctgatggagcccagaatgacaaaggtgaccagcgccacccggaaaacccggttcacctggttccgccggtccagggcgttggcctcggagatggtcttggacatggccaccggcaggccggcggtggagatcatcagcagcaggttgtagatggcgtaggcgttgttgaagtggccgaagcccacatcccccaagatgcgccccagggggattttatatagggcgccaatgattttcacgatggcgatgctcacggccaggatggccgccccgccgaaaaatgtgttgcttttctgcgttcgttctttcaaaagtcaattcctccggtcggcaaggctggcgccgtccccaaagagcaggggcagggcataggtctccacctcggccttgatccgctccaggtccagggtgaagaaggttccatccttgtatatgatctttccccgggccatattcatcaccacgtcggacccccgggcggaatagaccaggttgtcctccacactgtggcagggggtgaggctggggcggtcaaagtccaccaggatcaggtcggcggtatagccggggacaatctgtccggtcctccgccccagggcccgggcaccgtcccggctggccatggccagcacctggcggggcagcagggccagggggtcatgggtgaccccgttgtggagaatggccgcgaacttcatctcctcaaacatgtcgtggttgttgttggaggacaccccgtcggtgcccagggcgatgttcacccccgcccgcttcatggcgggaatccaggccaccccagagcccagcttcaggttggacacgggattgtggatgcaggagacccccttctccgccatgagggcccagtcctcctcggtggtccagacacagtgggcggcaatggcccgggtgtcccagaccccgtaccggtccaggatctgcaagggggtcttgccccagcgtttcttgcaggcctcgtgctcagactgggtctcggagacatggacgtgcatccccagttttttctcctgggcgtacgccgccatccactgccacagggggacgttggaggtatactccccgtggatggaggcgtccaccaaaatctggccgttccccgcgccgtgccactcctcggtgagccggcgctggttgtcacagtccttgcaggtggccgggctgaagtccgccggggccccgaagtagacccccccgcaggagagattggcgctgatgcccgcttccagcacggtttgggcgatgtcggtggtgtgcatgtacatgtcagcgatggtggtcaccccgccggcaatgagctcggccagggccagccctgtgccggcccggaccgcccggccgtccagcttggcctccgtggggaagatccactggttgagccaggtgtgcaggtcgcaccccccgccgtagccccggagcagggtcatggggatgtgggtatgggcgttgaccaggccgggcatgaggacgttgtttccgcagtcgatctcccggtcaaagggcccctggggacgctgggtgcccacggaggagatggtctccccctccacaaccacataggccccctccagcagggtgtccgcctcgtccatcagcagggcgcggcagtgatacagtaagcttcgttccatagcgggcctccttccctcagttcaggtgctccaggcaggccagcaccagggaggagaaccggtcccgggccgcggcggcggcctccagcacctcttcctcgctgagctttttgggcagcaccccggcggccatgttggagaccagggtgaagcccagcacctccatgccgcagtgcccggcggtgatgacctccggcgcggtggacatgcccacggcgtccgcccccagaatccgggccatgcggacctcggcgggggtctcgtactggggaccggggaagtacatgtaaaccccctccttcaggtccatgtccagccggcgggcctgctggcgggccagctcctggagccggggggtgtagaggtagctggcgtcggggaaccggggaccgaactccgggatgttctccccccacaggggagactccatgaaaattttaatgtggtcggtgatgagcatcaggtccccggcctgaaacttccagttcaccccgccggcggcgttggtgacaaagagggtgtcgcaccccagcaggcggagcacccggaccccgtagctcacctcctcataggagtatccctcgtagtggtggacccgaccctgcatcacggccaccggctggccggccaggcggccgaagaccagctgtcctttgtgtcccggggcggtggaatgtttaaaatggggaatctccccgtaggggaccaccacggcgtcctccaccaggtcccccagataccccaggccggagcccagaatcatggccaccttgggccggaaccctcccagcttggcctgcagagcgtccgcgctttcccgatattgggcaaaggtataattcatagcatatcctccatctcggggccgcgcccctgttttttccctggcccccggccagggtttccgtcaagtatactgggatatcttacacccactgcacggaaaaatcaaataaaatccttggcgctgcaaggttttttctcccttggcagggggccggggcgggatttttcccccgccccgcctctgtcccgccaaaaccgccgggcggctgtttttctgcttgctatttcctgccagtccgtgctataatatcggtgaaaaacaaaatatgcggcagatttcagggctccgaccccctgaaatcctgcgcaggtgccataaccacctacacaacggcccaaggccgcaccgcatggacgatattatacagtttttccagaccctttgcaagggtttcccttgctttgcgcgattgaaggactgtcttttgtcgtagtcattttcgggtgtgctccaagggcaaagtgtgcataggcatttttgcctcctgaccttgtcgtgtagggctgtgacctgcacggcatttttgtttttccccgacccgctcgggggaagctgggcttcccccggggtttgggcgggagaacgatacaaaacagcgtatatcgttgtaccaaagacagattgaaaaaggaggaaaagagatgaggaagcgtttattgtcgtgggtcctcttgttcgctttggcgttgtcattgctgccgatgggcacgttggcagcggaggagacgcagagttggcaagaggcctatcgggagtatatccagtctgacctggagaacacggcaggtagtgggtatcttgacggagcaaaagaggaaacgaggtatttcctgttcgatgtaaatgaggacagcataccggaactttggattaactattccactagcgcctatgggaagcggttgtgttcttatgcgaatagacaagtccaagtacaaaatgttgcctatggagagctttcctacattccagggcagtctctggtttttacctctggagggcacatgggatatttttgggatactgtttatcatttagagaatggcaattttaaaatagctgaagaagggttgattaaaattgtagataacaacggatatgaagtttctgaaaatgagtaccgatatacctggaataaccaggttgtagataaatcaacctatgaaagtaagttaggtgctgcttttgataccttgcaagcagtaaacccgccgcaggatggaggtctaacatatcaagaggttctaaatgctctgaacacgagtaaaactccgccggaaacactttataggcaaatcatagataaatataagacaggtgttgacgaaaagtggacaatacaggaattttcagagaataatttggcctatgtatgtggataccggccagaacatgttggctatgcatttatggatcttgatggaaatggcgtaaaggaactcataattggagatacggaatatggaatagatggcgtgatatatgcgctctacagttacgcagacggaagtataaaggaagttttttcgagtggggagcgcgatcgccacagcctttgtgacggtggcattattcttaatgattggtcaaatagtgcttggaataatggccgcgcatattacaggatttcaggaacaacattatctttgaaagaaagaattgtgggagataaagataaaaacggaaattatgttcaattttatagcacaacagaaaacgatcaagatttaatctccattacagaagagaaagcacaggaaattagagattcttatgtcaaggaaagcattcaatatacctctttttcggagtataatccagacgcaccaggaagtgaagatgctgccaatgctttgcaggaacaatttataaaagagcatatagagtatgctaccagcaaaaattacaaacaagatattgttatgggatatagcaattatctcttaagtattttagaggagtcgcaaaaagatgcttctgtttctggatataatcttttgaatgggcttaacaatggactaaatctcgattttgaacttaatgatgttgatatgtacgagctgattttgtcagagttgctctatagcgagcaaagtcgggatggattacagtccatgtaccaggaaaactttgtgaattcagcgattttggttcttacaaaaatactagaaaacgcatccatcaaagaatctttgggagacgctgtttttaatcttctcaaaaacaaacttgctgagcttgaaaaagcagcagatgatactgaaaattttattagcgtttttgacactataatagatattttgaatgatagcacgtcgaaagaaagccttgttgattcattaaaaaacagctctttacctcttgaaatcagcattgatggactgcaagcagtctgtacctcagctaaagatattgttgagtatattgttgccggaagcgcatatgcaaatacgcaagaagaatttgttgaggttctaacaatattgcttggatactctgggcaggttgcaaataacggttgggacattttcgttgatattccagctatggatcgagtaattaattctagtgcgctctgttctgcacttaataactttatcactagaatggaaaaatacaaacaagacaatataacggctgttgcagaatattctgtacaagtgttaggaaatgagagtcacgattttatggttgattccattaaaaaaattgcgttaaaaggtacggatgccatgctttctctcgttccggttttaagctgggctgtgtcaataagagagtcccttggaatagggctgtcactagttgagatagttacaaatgttgatgaaacggcatatgcagctgatatgattacaaaatattactgcttagctgttcttatgaataagacagtcgatggatgcaaaggtgggttgttgagcgaggatagtgatgctatccagtttaaagcggctgttatttttgatcaatctatcaatatgtataagtcggttataaaactcgcgtctgactatgctgtaaaatatgaaactgaaaaattaaagacagcaataaggcaagatagcatatctacacattccttcgcaatatctttagcgatgacacaaaagattctttgcgatgaaatacgttgccattctgttggccttgagtatgatccctcttcaggaaccgtattttacaatacatctgctttgaaagtctatacaattgcttgccctgttgatgctattgtaaaaacagattcagggaaacaaatagcgcatctatcaaattcgggaaacatcgttacctctgggtatgaacagtattgctttactgtcgaaaatgaagctaatagtagtgataaaattaaagtgattgttgttccaacatcttaccaagtaacgctgaagggcacagacaatggaatcatggacgcctatgtggtaaatataacaaacgataaaatcgaagacgtttctgcgttctacgaagttcccattacaaatggagcagaaggtacatttgtcccatcgcaacaaaatgataaagttgcaaacttaatatttgatggaaagacctataaaccaactgtgggagaagttcctgaccagcccgtccccacagaaccctttgccgatgtcagccggggcgattggttctatgaggcagtccagtacgtctacgacaagggcatgatgaccggcgtgtcggcggaccggtttgcccctgcctccaccaccacccgtgggatgatcgtgaccatcctctaccggctggagaacgagcctgcggtgtccggcggcagcgccttcaccgacgtggagaacggcgcctggtatgccgatgccgttgcctgggcagcggccaatgacattgtcaacggcaccagcgccaccaccttcgcccccaacagccccatcacccgggagcagatggcggcgatcctgtaccggtatgccgcctacaagggctatgacgtgagccagaaggcggacctgtcgggctacaccgacgccgcctccatcagcggctacgccaaggacgctctggcctgggccaatgcccagaagcttatcaccggggtgacggacaccaccctgaacccccagggcagcgccacccgcgcccaggtggccaccattctcatgcggctgtgtgagaccgtggtaaaataatctacaaactacccgagaccggggagggagctgcggctctctcctcggttttttctctgggttgggggcagagagcggtgggggctttttccatcgccgttggaacgggcgggaacggagccctcccgggcggggccctatttctttgaagaaataggggaaagaacaccaaggggaaggaggttccttccccttggaaccccattctctggtgggaggaatggggaaaggtggttggtcaggtaggggcctggcctgcggcctctaagaccaacgcctcatggcccgcccaccggctcgggcgggcgggagaagtggttcgttgacgggaggaaaaagtgggaaacgaaatggtttttctcctccttttcccaaagggt

SEQ ID NO: 2263 - DNA, 6835 bp, KLE1738
acggcctcggtgttctcgatcttgtcctgatccgagaacgccgccccggcgcccatgaccatgacagacagcatcacagccacacagagcaccaggctcagaaccttcttctgggggaagcccttatctcacaacgctttgcctcgcaatttcccacagattttccacggcgttcccacagttgtttcccctccccacacaacagaaaaatcccccagcatccgcgcaatggggtgctgggggatatctggaggaaggacatcaggggaaacaccgcgtcaaatggcgtgccgctgtacgctggtggaaaaagcggcgtctccagggtgggggcggcagcgggttgtccagagattggccgcccaggcgggagagaggagcgtgatggtatccatatgcatagacagccaggcccagaacgcgggacccaagatgacatccgctgtggcgatgaagaagggcccctccgccgtcagctggactgctgaccccagacggtcgaggatttcatccgccaaagcgcggcagcagcgaagccgcacccgctcccgccggttgggctcgatgccgaagggggctgcggtccacagtgccgggtcgggattgggcccctgcgcgggcattcccgtgaccagcacctgagacatccgatccgtgcgatagagggccaacgatttgcttcgatggttccaccccagcaggtgatacccctcctcagaccacagcagccccttggggctgaccaccagagtgtactccgagaaaacccgtctccgcgccgggtcgtacacaaacgagacaaaacgcagtgcccgctggctttgcagggcggtgtggacgcggtccagcacctgccggacctcctctggcgctgtcaccccctggggcggcagcgagaccgggcggcgcagctggccgcgctgtccccggggaaagagcccggccagcttgtccagcagagacgcccgcagcgccgctggaatccagcggtagaccgccactgcgtcaatcacggtttgaagctctgagaggttcaacggccgccccgccaggtaccacccgccggtcttcccgtggcggtaggccacctcaaacccctgcttgttcatggcggccaaatcccgataaatactttttcgctcggaagccacgccctcctcctccaaacgccggatcatctccgtcatgggcatggggtgcttttcgtcggtttcctcatataaaatacgggcgagacacagggtgcggtctctctggtcggtgtgctttcccaccttcatccctcctcttggttgatgctctcattatagaacatatgttctaattttgcaagagggagaggaggtggtgtcccaaaaaggggagggattttgtcattcccaggttttccactgctccggctggtaacccaccgtggcctgttttccgttgcggacgatgggcgttctcagcagtgtgggattttccagcaccttctccaccttatcctggtcataggccaaatactggagcagcgccgcgtccgggtgcttggggtccaccaagtccgaaaggggaaccgaccggagcaccccattgagctcccctctgctgatgccatatttcttcatgtcaatgtactggtattttacccggcgctctttgaaatagcgttccgcttttttggtgtcgaaacacttggacttaccaaaaatctgaatattcattgctgcctcctggccccttgggcggggggattttctcttttagcttatcacattctgttccaaaaacccaggccttccaaaaaatatgtatactttttccggaaatggtgatatactaccaataacacagtgaaaacagcggtccgctgttttcttttctcatttgttttttactgggaaacggccgcgatgcggcatgagataaaaatccaccgcacagaccaccgatctatgcttgaggacagggaacacagacatcacccttcgcgggacagggcggacgggtatgcctggcagcttccttttctttctgtctctctttttggggtctgtctctgcggaattttagaaaaaaggagttattatggcagaaaaactgaaaatcattcccttgggcggactcaatgagatcggcaaaaacctcaccgtctatgagtatggcaacgatattatcatcgtggacgtgggcatgggctttcccgacgatgatatgtatggcgtggacgtggtcatccctgacgtgagctatttgatcaagcacaaggacaagatccgggggatctttctcacccacgggcatgaggaccacattggcgccctgccctacgtgctgcggtccttcaacgcccccatctacgcgacccggatgaccctgggcttggtgcgcctgaagctggaggagcacaagctcctggacaccaccaagctggtcacctgcgaggcaggggacatcatccaggcgggcaagttctccgtggagttcatccacgccaaccactccattgccgacgcggtcagcttcgcggtgaagtgtcccgtgggcgtggtggtccacaccggggactttaagattgaccccacccccatcaagggaaaaatcatggacctcacccgcctggggcagctgggcaaggagggggtcctggccatgctggccgactctaccaatgtggaacgccccggccacacccggtctgaacgggccgtgggggccagcttcgatgaactgttcaagggatgcaaggagcggatcattgtcaccacctttgcctccaatgtggatcggattcagcagatcatcaacgtggccgcccgctacggacgcaaggtagcggtcactggccggagcatggagaattccatgcgggtggccaccgaactggggtacacggaaatcccccaggggattcttgtggacatcaaccacatcaagtccctgccccgggaaaaaatctgcatcatcaccactggcagccagggtgaggccatgtccgccctgttccggattgccttttccacccacaagcaggtggacatccaggcgggcgaccgggtgatcatctctgcctccgccatccccggcaatgagaacgcggtgaacaacatcatcaacgagctctaccgcaaaaaggctgaggtggtcagcgagaacgctggcgcccttcacgtgtccggccacgcctgccaggacgagctgaaaatcatccacgccctggtccggcccaagttcttcatccctgtccatggggagcagcgccacctccagacccacgcccgggtggcccaggagatgggaacccccccggagaacattatcatcggcgacgtggggcgcatcatcgaactcaccccccactccgcccagttgggcggcacggttccctcgggccgggtctttgtggacgggtacggcgtgggcgacgtgggcagcgtggtcctgcgggaccgccggcacctggcccaggacggcatgattgtggtggtagtctccctgtccggagagaccggagagctggtctccggccccgacatcatcacccggggcttcgtctatgtaaaggaatcggagagcctcatggaggaactccgggaggtggccttggaggccctggatgcctgccagagccggggcattggggactgggccactatcaagtccgccatgaagggcgagatgtcccgctatctctacaagaaaaccaaacgcaatcctatgatcctccctgtgattatggaggtctgatttggctcccccgtcggcacgcctgtgccggcgggggagtagcgcattctaaacaggaacagagggagaggcaacttgcctctccctctgttccaacacagcagagaagagaacccggtgggttactcggcgctgctcatgccctgctcataggactggatcatctttttgaccatctggccgccgatagaaccggcctcacgggtggtcatagagccgttgtagcccttcttcagatccacgccaacctcgttggcagcttccatcttgaacttgtccatcgcggcgcgagcctgggggaccatgatcttgttgttgctggaagacttattgctagccataacaatgttctcctttgtttcatgttgaaatgagagattgtaaaatcaaagaacgaacttgcgtcgttctggagcttatcatggccagattgcgaaaagatatgcggaaacggggatttgtaaattttagaaaaacgtgctcccctcaaaaaaggggagcacgtttcattgtgatttttaattagaaaatcagttgagagtcacatttacgtacacagtagcagtagcattattgtttgcaatagtaattgcgagctttacgctgccatctaccatattctcagtagaagtcgcagtcaatttgccgtcagcatacttaacactggtaatcttggtcgcagtatcctcaacaatagatgccgagacagtagtaccattggcagagaaagtgatcagatcaagagattttccgtccgtgttggtcacggtttttgtataaggcttctcagcagtaccatttgcagaacctgttgtaacggcactcttcaaagcactaactgcatcctcaacggcctttttatcatcagcaacaaccgggttgtcaacagcttccagatcgttgttcacatcaacaaacagaacctcgaccttgttttcgctgtccagcttatacattacgtttgcaatgtacttgtcgttgctgtccttggatgctgtgcggatcttgccgccgtctacacccttggtgtctgcggtgttgacgtaaaccacagtggcatcatcggccatcttattggcgaagggagagatagcgctgttatcagcctggaccatgttgatgtcctcgccgcctgcgtaagcggttacagcaccggcaaacagattggcgtcgtcacccacttcgacagtcttgatggtcgtaccatcacccacgttataagaaatgaagtcacccttgttggcgtggacgtcagaagtcttttcgcggacgaccttctcaccgtcagcagtccacagcgtgtactggatgtagttggtgccatcctccttgatcaggtagggatccgcagtcacatagccgtaagcagtgtcaccggaggcatcggggatattaccacttgccagtttgagagaaccaacctgcacgtacttaaagccattggactcagagtacagcacaatgctgttggccgcggtaaaggaaatcgaatccttgccccaagcgtttacagtggcgccagagacaaccttggtgtcgtcggcaccttccacgaagatcactgcatcgtcagcgatcttggcggtgctattgtccttcagagtcagagtcttatcggcataggagttaaccgtattctgacccttgaagccagctttgttggaatcggagatagtcttgatctcgtacttgtcgccgtccacggagaaggtgtaaacgagatcaacgatggaagtcatagccttgctgtagccagcactaccagcagtacctgtatcagagctcgatcccgaaaccagtacctcgcctgccttggcagagccggtagtcacaactttatagccatcaatcttagagatcaatgcttctttagatgtaccatcagtgaagtacaacttggcgttcaggccagcattcagacccgtcttgatctccaaaccatcaacatacagaacatctgcggaagtagcagtggtatcggagatctcaacatcaaatgcatacctgccaacggtcacaacgtcaacagtgtcaccaacattgaaggtctcgccagacaccaaagaggtgtaccaggtgccgtcaatcaggccctcagtattgttgttgcgggtaccggtcacttcgccagtcacaacagtagctttctccacattgtaattgccgtctaccgtatcgctatctgcgtaaacgataacccagtcatcctcggcaatgccgtcataagcagtgacgtcgtccacgtccttgttgccgatggtggcaaagccgttaacagcctggaaggtcatggaagaggttcctacataggtaacttcagcaaccgcaaagggcgtcacaactgcacggtcaatcttgccgtttccgtcgttgtcgatcagcttaatgctgtaagcatcctgcacaccgctgtgagtcttcgccaaagaaatcagtgtaccagcatctgccgttttgttaaagtgatagaccttagcgccggtatcaatcttatactcggtgctgtccagcttgatcttctcgctgtcaccggttacaggatccaggtcacccaccacgccggtggcaatcactttggagtcctcattggcataaatgccatagaccttggactgatcgccatctttcaccatgacgtcaaccttctggcccatcagatcagagtagtccttttcaaccttggtatacgtcgtagtagtatccttgttcgtcacgacgacattgtaggtgcccttgctgtccttattaatactggtcaaaataccatcatccacgatggtggcattgtacttgtccttcagcagggtgatgggattgttggcattgtccagtttgtcaaccgcagtcaccttggtggcgtcgccgcccacccaagtgtactcatacttgacttcgccagcctgcagggcgttccacaccatctgggccgcagtgtcgcgggtcagggcagcggagacatccagaccttccaggcccttgtacaggcccttctgggtggcacggacgttgacattcatgtcccaagcgttgccggtgtagccctcgatgtcagaatcgaagcccaggcagaccagcagcatcttagccagctgggagccggtcacat

SEQ ID NO: 2264 - DNA, 6199 bp, KLE1738
tggtgggagttccgtgtaaaatccgtgggaaattgcggagcgaagcattgcggggcaaggagttcccccagaagaaggttctgagcctggtgctctgtgtggctgtgatgctgtctgtcatggtcatgggcgccggggcggcgttctcggatcaggacaagatcgagaacaccgaggccgttgatgcgtgctctgcgctgaacatcatcggcgggtacgaggatggttcttatcatcctgagcgcaacattaagcggtccgagatcacgaagatgatctgcgtggccctgaacggtggcaaggagcccaacgtctccaccaacgtcacccccacctttaacgatgtgcgcggcaccaacgccgcctgggcagagggctatattgagtcctgcgtggcccagggcatcatctccggcgtgggcggcggccggttcagccctaacggcaacgtgaccggcacccagctggccaagatgctgctggtgtccctgggatacaatgccgatacagagggctttgtaggcaacgcttgggcaaccaacgtcaacgtagttgcatcccagaagggcctgtacgaaggtctggagtctatggacgcctctgccgccattacccgtgacaacgcggcccagatggtgtggaacgccctgaacgcctatgaggtggagtacaagaccaccatcatcaccggcgaggacggcaagctggagaccattgtcaccgtccaggataaggttgttggctccaacaacgacaagatcaccctgctgcgggacaagtatgatgcttgggtctatgtgggtaccctgaccagtgtgaagagcagcaatcttaccatttccatgactgctgcagaccgggccgccagtgaccccagcgtagacaatcccgccggtggcgccaccaccgtgtccacagtagattttaccaagctgaccgttgactactccaacctgctgggccagaaggtcaaggtcatgttcaagaatggcaagaccaatgaggttctgggcgtgtatgccaccgccgacaataccatctacaacactgtgatgaacgcggtggacaacgacaatggcaagattaagttcggtggcacctcctactccacggacagcgccatcaccgtttatattgacggaacaaagcttgtgggccccaagactgcggctgactttgacgatgctgccggcaaacagctcgacagtacgcgtcctgtcgacaacaacatctccgctgatgaagttaccttcgttgattccgacgacaacgggaaaattgacactgcgattctgaccactgtcgatgcagccaaggttacgtacatttcctctgacgaaattgttgccggtggtacgacctataaatatgccgacgagaagatcgcctccgatgttgagaagaatgactatgtggtgattcgtcaggacctctacaacgactgcaagaacatcacccgtgctgacaagctcaccggcgtgaaggttaccggcaccaagcagaatcctgcccagtacctgatcgacggcagctggtatgtcgccggcacgaaggcggatatgaacagcgtcaagtccggtgacaccgtggacgcgtacaccatcaatggcgttgtcttctatgccaagcgcacttccggtgagaacgccagcctgtccgatgttgccatcgtcctggcggttggcagcgacatccagggcgacaaagccaagatccttaagctggatggcaccacctccaccaccgagatcgtcgatatcgacaatgctccgggcagcggttacgttgcgaagagtgctctcaagcagggcgctgtttacgagtactccgtcaagggcggcgaataccgcttcaaggatctgaacaccgctacggactacttcggtgattacaccgcgctgaacgatggttctccgaacagttcttcttctggcatggctgttgctggcgccgccaacagtgacaagagcatcaataacatcaaggtcgacgattctgcaaagatcgttctgatcgacaagtataacactaccggtacggattataaggtcatcaccggcaaacagttcaaatccctgggtgttgctggcggctcgaacgaggcgtacagtaacggtggcattgcggcgttcatttccaaggtcaacggcgtaaaccgcgtgacctacggtgttgttgcggtcaatggcattgcaaacaactttatcaccaacgaccactacggttatgttgttgagagctcttaccagtcgagtgacggctacatggtttacacgatctggaatggcactgagaacgtgaaggtgcaggagaagggcaacgcacagcgcaacaagggcaccgttctaggctactcctccatcaccacggagagcggtctggctgacaacgttgtcggcaccatcgaggatgttgacgacagcttcggcatcgtcgacaacggcatcatttacggtgtcagcgacgaccagaaaaccatctccctggatggctccaataccaacgaaatcaccaaggacaccgtcgttctgtacgttgacaccaaagaccacaagggctatgcaaacggcgaaatccaggaagcagatgactttggttctggcaagatcgcgaacgttatgtacaagctggatggcacggcgaaggattcggacgttgccctgctgatcgttgacgtgaagaacaacttgcacggcgcgttcaagtacaactttggcgcggacgcaaacgcagctgatatcaacctggcgctgagcaagggggagttactattagcggcgcactggatactatgacgttgaatgttccggcaaacactacgctgaccattgcagctgcgcagaccaatgatgtcaccatcaacgttgcgaagggggccacactgaaggttccgaatggtactctggttggtgcaaatggtgcgtttaccgcagcaggggacgttacagtgaacactgcaagcggtaagacgcaaattagttctgctgccgacttgacgctgaacagcaacgtaagcctgcagaatggcgataaaattacgctgaccggttctgcgaagcttcttgccaaacaggcaggtattacactccacattgttaatagtggaaacgtctccgttatggtgaacaatttctataacgacaccagcgacgctactgctgatggcgttgcaaacgagaactgcacttacacttggacagcttccggcacaggcagcctgaccagtgatggctgggttaagacgtaagaattcctaagtggtaacccattactctggcaataggagcccccctcttttgaggggggctctttctcttcctcatttgaatgagagatgctggtatggtgttacctctgcatgcgtaaagaatccccctgccggtagttttattttcctatatcaggagttttcccatgagtaaacaaaaacaaatatgacaacaccatcacaaaccagctgccttttcggaaaccaacgaaataatcaaccgctatattcaaacatatcaagccaaagacaggagaggcgccgctgacgcggcgcctctccgatgaaatctcgagcttccttcccagggtctcctgccttctgtctttacaaacaaggacagtccactaaggaagaggtttttgattagaccaggctgttactgcggaacagatgcgctggtaaagccgacagtaaccgcctcactcggcatggtaaaggttgccgtggcagatttctgccccttcgggatagtaatggtcagagagccaacgccttgatcaacagacacgaccacagtagtatccttgccagcaatcgccttgttcagggtggctgtcaaagtaaccttctcacccagtttggcagtcgtaggggaagccgtaacggtaactgttttattattctcaccattggttacattttcgcttgtaatgttgcaggtaacagctttggccttcagagccaggccgccgtcagccatatccagcttatcgttatcaaagataacggccaggatcttgccgctgccgtcggtcatcacataggcattcgcatagtagttgccgtactgatcctgctgcgccagcgaaaccgcgctcatgtcgccctcgacaccagtcttggcgctgtcgtcgataccgatgaagacgcaatcctcatccagcgtcagggtggaggcagcaccgtccgcatatttgaccaaagccatctcgccttccgcctcatagtcgaagccggtgatcgcataagcgttagcggtatccgtcaagccagcgtcaacaccgacaaagttgccgtccaggtgatactggatcgcgtcgcccgccttcacgccgtccttaatcgcggaacccttctcataaacggtcgtattctcggagcccgtccagatggggtaagctacaacattctcgttctcatacttggtggtgtaaggatctgcggtgaggtaaccgtacagcttgtcaccatttgcacccggcaccgtgttagtgttgactgtcatggctgcgaccttggcatactggataccgttggactcgctggtcaggacgcccttaccagtgaaagtgccagaaacagtattccagttcttcacggtcttgccggtcagcaccttgacctcattcgttgcctgaacaaagatgactgcgtcatcagcgatggagccgctgtcgagcttgttggtcgggctcttatatccgcccttgtcatacagataggtatcgtagccagccttgttctctttaatgacggaagcgccgccgatcttaccgttgttgtcagtggcaccgtcaccaaccaccgcgccaatgttattctttgcgtcagcattggccaactgtttcagctcatagttgccgtcagagtcaatggagtaggtgaacatctgatttgcaaggttatccttcgcaataccaacactgccttgagtgaaatctttggtagccttggtaatatcttcaccattgatcatgtcgatcttgacgaccttattggttccgtcagtaaagtaagccttggcttcaactgtaaagttgtcacccagcttgctttcagcagcttcgtttgcagagatgtacaggatatccttggaggagccggaagcatccgcatcataaacatagccgtttacaaccacaaatacacccttatcgcccacagccggggtctgtgtgttcgttgccatcttgtaccagtcgtcgccgatcttcacttcatctggagaaccagtgcgaacgccggtcacttctccctcgatggtgccggcctttgtgatcactgcgttgtcagtggtcgtgtagtcaccggcgacgatcacggcccagtcgttcttggcaacaccttcatagatgtcgtcatcctcaaacttataggacttgttgcccgcggtgatactggtggagccaacgtaggtgacttcggccacggtcatcggggttacgatcatggaatcgaccttgccgtcgccattgttgtcgatgaacttaatttcatcagaagcgttggcattccgattgttgtagatggtctgcagggttttcttggtatcgggatcattgttgtagacaacattctcactcaacgccgttttttcaaatttgtactctacaccgttgagcttcatctttttggtgtcgttggagaccgtatccagttgtccaacggcacctgttgccagcaccttggagtcctcgttggcgtaaacaccatacacggtgttgtcgctgatcttcaccaggacgtccaccttctggcccatcagatcggaataatccttggcgaccttggtgtatccattagcatttttgtctgtcttaacggtgtaagtgcccttgctgtcctctttgacagaggtcacaataccgccgtctttgacttccgcgttgtacttgtccttcagcaaggtgataggattgttggcattgtccagcttgtcaacagcggtcaccttggtggcgtcgccgcccacccaagtgtactcatacttaacttcgccagcctgcagggcgttccacaccatctgggccgcagtgtcgcgggtcagggcagcggagacatccagaccttccaggcccttgtacaggcccttctgggtggcacggacgttgacattcatgtcccaagcgttgccggtgtagccctcgatgtcagaatcgaagcccaggcagaccagcagcatcttagccagctgggagccggtcacat

SEQ ID NO: 2265 - DNA, 7373 bp, KLE1738
cgccccggcgcccatgaccatgacagacagcatcacagccacacagagcaccaggctcagaaccttcttctgagggaactccttatcctccaatgctttgcctagcaatttcccacggattttacacggaactcccacggcgttagaactaaaataagaggatatgtgttgtacataaggagcaaaattttccatttctcaaaattcattttgtccgtctgacgaagccttttatatacgcctaccctatcatttcagcgacaggataggggttgttttctctgttcttatcccgtataataaataatattagacaatgtgagtcaggaggaaaatgaccatggccagatgcaagtcctgcggggtagaactacgcacgggggcgcggttctgcgatatgtgtggcgcaaaagtggaaaaaatctgtcccaactgtggagaagtgttgcgggcacaagccaagttttgcgatttatgtggagagaagctccctcttgcacagttgatctctcggccgaaagtccatggtgatatctgcgctggacgcctccataccgtagctctgaaggaagatggaaccctcctggccacaggagataatcagtttggtcaatgtgacgtagcggattggacggatgttgttgctgtggcggctggaaaatatcatactgtggcagtgcgctctgacggaactgcattggcaacaggagaccgtacgtatggccaatgtgacataggagattggacagatattgttgccgtagcagccggagacagccatactgttggtctccggacagacggcaccgtgattgcggctggccgggattcttctggaaagtgcgcgttaggaaactggaaaaatatcatcgccgtagcagctggtatggatcacacgttgggcctgtgtcaggacggcaccgttttggctgcgggggagggcctttttggttcctgcgcggttagtaagtggaatcatatcacattcattgccgcaggccatattcacaccattgggatcaatcagatgggccgtatccaagaggcggatggctttgcagctcccggtgtcatggactggagcgatatttctcgggtggcagtcagcccatttcatacagttgggctgaaaaaagatggcactgttttggcatccggcgatattcagtatggacaatgccaagtcgagacttggtctcacatcaccaatgtggctgcaggagagcgccacaccgttggcttaaaagaagatggcactgtcattgcgaccggagacaacgaggctaaccagtgtgccgttgatgggtggcgtctttgggaagaatactaaaaacttagaaatcatcccgttatggaattctcccataacgggatgattgtttaaaaaatagaaataattgcgtgggaacgccgtggaaaatctgtgggaaattgcggagcaaagcattgaggaataaggagttcccccagaagaaggttctgagcctggtgctctgtgtggctgtgatgctgtctgtcatggtcatgggcgccggggcggcgttctcggatcaggacaagatcgagaacaaagaagccgttgatatgtgcgcggcactgaatatcatcggcgggtatcctgacgggtcctataagcccgaagggaacattaagcggtccgagatctgcaagatgatctgcgtggccctgaacggcggcgaggagcccaccctgggcacacctgccacccccacattctccgacgtgcgcaacacccccaacgctgcttgggcggagaagtacattgagtcctgcgtgtcccagggcatcgtgtccggcgtgggcggcggccggttcagccccaacggcaatgtgactgccagccagctgtccaagatgctgctggtcagcctgggttacgattccgacattgaaggttacaccggcaatgcttgggacatgaatgtcaacgttcgtgctacccaggttggcctgtacaagggcctggaaggcgtggatgtctctgccgctctgacccgcgacaccgcagcacagatggtatggaatgcgttgcaggccaaggaagttggctatgagtacacgctcgtgtctgagaatggtcagctggtttccaaaacagagctggtccctaaggctaccactttgttggaatctaagtatgagggcaagatcgtcgaaggcaccttgagccagtttagctacaacaccaacaaggaagagtggacttatgagattgctgtttccacaagcgacacggttcaagtaaagagcacacaggacttcaccgctctgatgggccagattgtgaaggctgtctatgacaacaataccaccggcaaaatcaaggacgcctatggcatctttgcgacggacagtgaagttgtcctcacggcccgttttggcgacctgcccaagatgactactgcgacggacacctccttcaaagtggacggcgtcacctacaagctggacaaggcgctgaatgaaacgcccgtgatgcagtttaccgcgaataacaataccaaatatgaggctgaaactctgtatgcggttgctggcggtgacaccgtaaagtatgacgcgcagacgttcactgcggttgacaaagacggcaacggcaagatcgacttcttttctgtggcccccttccaggtgctgaaggtgaactacgtcaacaagaccgagttccgtctttccaacaacatgaagtacaccattgaggacgtgaacgtctatgacggcatcgccaaggacgactatgttgtctacaccgcagccgccaacacggccaccgacaccgacaccttcgtgaaggccgacatgatcagcggcaagatcacccagaaggacggcaacgatgtctacgtggatggcaactggtacaccttggatgccagttacaaagacgaaggcaacaccggctccgttggaaccgtgctggcagatgccgttgtggtcaacgggtacctcttctatgccgacgagtccggtgccaccaatgttgaggactatgtcgtggtcgtgagcgatgtggaatccagctttggccaggatcaggtcaagctgctcttctctgacggcaccaagaaggtcgttgatttggcgaaggtgggaggtgaatcccagtcgcttacggtgggctccctctacacctatgacaccaacaaggacggcgagtacaccctgactaccgcttctgttgtcggcactggcttcgacaaggctgctaacaatggtcaggtgaaagcccagagcagcagttcttccaaggctggttacattgacaactatgctattgcggatgacgctgtgatcttcgtcaaatacaacaccaacgactacaaggtcatctcaggtgcaaccatgaagacgatgacggcaactcagttcactgcggtgagcttctacctggccaccgacaattccaacaccggtgtaggcgacgtcaatatggcgtatgttacttctaacgccacgacaattaagggcggcgacacgttctatggattcgttacctcctccatcgagaccgagaatgaggacggagataagatcctgtctgtcaccctgtggaccgctgaaggcgagaagaagctgaataccgtaaaagtcacgggcagcagcctggatgccctgacgaccggcgctgtggtctcctatgacctggacagcgatggaaacatcgacacggcggaggctgtcggcgaacccgctgccattacttcttgggacggcaacgcgatgaccttcgctggcgatgccaaacggcatgagatgagcgacgacgtggagtacatcttcatcgatgacagcgaggatgtgggtgcggacggtctgaccagcaaagatattgctctggctgacgagccctctgaaggcgcctttaccagcaacgcttatatcctgactgatgacagtggtgatgttgtactggttgtctatgatgtggacaacgaagtggatgccaaagaaacttttttgacggggatcaagagtgaccaagatgtgaagaatgcggctgatggcgtgtataccccgacggagaaggagttcgctgcgagtgggaacatcactggcgaagcgcaggataaccgtatcatcaagttctctgcccccgaggaggctacctacactctgactatcgtcaatagcgaaggagagcaggtctatacggagacttctgggaagatggaagttggtcctcatttcttctatatttgtgtaaatggtgccagcacgagtgctcccaatgctggagatggaacatacaagacggagagctttgcaaaaggttcttacaatgtaaccgtcaccactggtacgggagacaatgtaaaaacagtcctgacgggttcgtttaccgtttgagcacatcgaacaatgtaaataccgaataaaaaagtaccatcccccggaaatcccgggggatggtactttttatgtatctcaccaaacattgttggatcaacacagcggtgcacagatcaatagatcacagccagaacttcgtggtcaacagtatccacaacagcgcgtaccgtttcgcccttctggattgcatcaatgctttccgcatcaccggaaacggggataaagatggtgtcactggtgacgaagtaattggtaccgttcaggccaagcatgctgttgtacagtgcagatgtgaccgtgtactgagcggcaggagaatagtccttaacatcaatcagggtggtgccgtccacgatgagctgatagatgccttcctccttcagcgcatggtacagccgcatcaggtcggcgtcattttcccttgcgtattccttgctggtcagcgtgactgtctctccagcggccagaataacatccacggtcaggacatacttaccgtcgctggtctcgctgacgatgcggttggggttgccgtccacataggcatagaccagggtttcgtccaggttgtcctccacagagatgtacgccaggtcaacccagatgtttccattcttctggttgccgccggtaaaggcccactgaacatttgcttcctcatagccttccagatcggagcccttcacaacctgataggtgtccatcttgttgttgtacatgaagacgacagcatcgtcctcgatgtagtacttgtcggaaccgggattgccgttggcgtagttatagaagtagttctgggtatcgtccacaaacatgtttgcaacaccagcgttaacggatttccaagagccaaccgtcggctcccaagtggctgtcacaatgtagctgtaatcaccagcattagcgcccgcgtctattgtaacgatagcaccttccgcgtgaggggcatccgcactggcaagcagtttgggggaatagtagtcatctgccaaatcgaagggggtgccatgatcgttatagctgaacgtataatacgtatcttcggtcggcgattgagagatagaaatagtcaggtttgcactgggatcattcggagcttttgcaggctgcacatcatacttccagtagccaggctgggtcacaacgtacttctgcgcatcgttcagggtcgcgccggtcttatatgcctgctgtacgtcaaaattggtgccctcggcgggagcagcagtgccttcggctacagggatcagctcataatattccttgtccaccacgcgataggtgtacagagagcccacagtgggctgcttgccatccacatcgaccgtcttggtggtgccgtcggtgaacagcagctcggtctcccaaaccttgtctgcacccgcaggagttgcagcggttttggtggcgacaacgtactcatccagcacggggccgacattgttgccatccacgatgaacaggtaaccgttgacttccacaaagctgtaggtatctttcagagagatgctggagatggggaccaccttgtccagcagactgccattgtactccgtgtcgcccagggtcaccagccggtcggctgtgttcaggctgttggccacgtcagactggatctccagaacagtgtaggtgtccacaccggtggcagtgtactggctgggaaccgccatgacatagccgtcccgctccacagtgccgttgacaatgacgtcggtatactccaccttgttggccgtgttgcccttcagacccaggctgcccaggatatacgcatcctgcgcattggcatctacggtcatgcgggcatcgtcccgggcaatcatgttggtccggaaggaatcagccaccacattggtggtcttcaggaccgcatagggatagacaacgaccacatcgatgtcgccgccgccatcctggtcgatgccggcaaaggcatactgatcgtagatggtgtgtctggcgccagcaccggggaagccccagaaaccctgctcgccatactggttatagccgcaggcgatgctccagaaggtatcccaatccttggccgtgttgtccaggcggtaggtctcgccattgacctcaatggtgttgaagtggtcgtttttgtctcccatgtcgctgatatcgccaatgttggcgcttaccacaacgccgcccttgttgatccggaccagcagcgcctcgtcgtccttggccagcacggtcacattcatggcgaagagagcagagaagtcctgggtggtggtgtactccttgccatcaacggtgtaggtgtactcttcggtgtccacgttgtaatcaatggcagtcaggataccctccacggtgtatgcgttgtagaccttctccagcagggtcttgccccactcaatggcaccggtggaatcggtcaaatacttcactgtcttggcctgaagcgcattccagaacatctgagcagcgtcatcacgggtcagcgcagcagacatgtccacatcctctaactctttgtagaggccggcattgacagcgtccgtgttcacgtttacagtccaggcgtcgctgtcctgatagccttcagttacagcgttgtagcccagggagaccagcagcatcttggccaactgggtcccggttacactgctggcgggtgcgaagcgattaccgcccacaccggagacaataccctgggctgtgcagtactcgatgtacttattggcccaggcatcggcggtgttcagcacgtcggtgtaggaagaagtagaagtttcctgcacagagtctcttcctccattcagcatggcgctgatcattttaacggcttctccgcgctcaatgtttcgttcggggtgatagcttccatcctcgaacccgtcgataatgtccagcgcggcgcacatatcgacggcctcggtgttctcgatcttgtcctgatccgagaacgccgccccggcgcccatgaccatgacagacagcatcacagccacacagagcaccaggctcagaaccttcttctg

SEQ ID NO: 2266 - DNA, 6026 bp, KLE1738
ggacaaaatgaattttgagaaatggaaaattttgctccttatgtacaacacatatcctcttattttagttctaacgccgtgggagttccgtgtaaaatccgtgggaaattgctaggcaaagcattggaggataaggagttccctcagaagaaggttctgagcctggtgctctgtgtggctgtgatgctgtctgtcatggtcatgggcgccggggcggcgttctcggatcaggacaagatcgagaacaccgaggccgtcaatatgtgcactgcgctgaacatcattggcgggtatcccgacgggtcctataagcccgaagggaacattaagcggtccgagatcaccaagatgatctgcgtggccctgaacggtggtaaggagcccaatgtgagtaccaacaccacccccaccttcagcgacgtgcgcggcaccaacgccgcctgggcagagggctacattgagtcctgcgtggcccagggcatcatctccggcgtgggcggcggccggttcagccccaacggcaacgtgaccggcacccagctggccaagatgctgctggtcagcctgggctacaacgccaacaccgagggctttgtgggcaacgcttgggcaaccaatgtcaacgtgattgcctcccagaagggcctgtacgagggcctggagcgcatggatacctctgccgctctgacccgtgacaacgcggcccagatggtgtggaatgccatgaacgcctatgaggtggagtataagaccaccatcgtcaccgacgagaatggcaagctggagaccattgtcaccgtccaggataaggttgttggctccaacaacgacaagatcactctgctggaggacaagtacgaggccaagacctttaccggtaccttcgacggcaacgacaagaccatctccactctgaaagatggccagattcaggttgagggaatgaataataaaacgccctctgagtctgtaaccgcaaagttcacctatgattttgacctgaagtacatcggcgaagaggtcagcgtcctctacaaggacagcacgaatagcggtacccgctatcagcccgacgacaacgacaccatctacggcgtggttgtaaccggcaatacctctgttgtgaatgccactgtggatgacatcgacggagattataatacggccgggaaagtctctatcagcgacacttcctataaagttgctaaagaaggtaaaatcgtaaccaatctggtgaatgtggacactggtgctccctgggcaacacagaccgcgggagtctctgacattgaggagctttctaaggccaatggtgacacggtcaagtttgttctggatgaccagaacgagatcgtttccgtctatgtcaccacgacggatctgtacaaagtgaccgcagtctctggcagcaaggtctccatctccggcattggcaccattgataccgccgagaacggcacttccgtttatgacggcgtggccaaggacgatgtggttgccgtgactaagctgtatcaggataaacccgctgatgcgacctttgtcattgagaaggcagaagccgtgtccggcacagtgactgcttacaatgccaaaacgattacgctggaaggcactgtgtatgatgtttacaacgaggcaaactacaagtccggtttgacggatgatgctgtgactaagctgtcttccgatgatttggataaggagtttaccctgtatctggtcaatggctatgtccgcgctgtgcagaagggctcggaggacatgaacaactacgctattgtaactgacgttaacagtggcgtgcttgattccacctttaacgaacctaaggcagaacttctgttcgcagacggaaccaagaaaaccgttgtcctgcacaaggactctaccctttatacaaccagtagcgaacacaatgacactgcatttactaagacaaacaaggttgacaccgcacttgaaaagggtgaaatcgtcaagtatgcagaaatgtctaatggccagtacaagattgaagaggctgtgaaggctgagacatatactgcgaccgatacagccgctaacttctatgacaaggatactaaggctttgaagggtattgtaactgatggaaactgcccgttgttctatactacggcagatggagagtataaggttgctaatatccgaacccttgatgatattgacttgtcctctggtggaaagcagactgcttatgtaaccaatgatggtaaggtagttgcagcattcgttgctctggccggaaaaccctctggcgcctccgacgacaccctgtatggtatcatcaccgatgacggtcaagtgaccagcaagaatggcgatccttacaccatgttcacggtttggaccggcgaggaaaccacggtttacgtagagggcgataccgtctccagcctgaacaagggtgcgttggtctccttcgataagtcggcggatgacacctatgaccagtctgacttcacgatcctggatggcactaacactgccaagggccaagcgatcgcagtgagcgattacagcgaagccgaccagaccattacctttgcaaatgcactgaagctggaaggcggcgcctacgtggaagacggcaagaccaccaaggccatcgacgaggacgcaaagattgtctacattgatgccgacaaccagaccaagggcgatgacggtatgggtattacctcctttgacggtaccaccggatatgccaacgctctgattgtttatgagggtggtgttgctaccaacaagatcgttgccatcattgtgaataccaactctgatacgaatgtgttggggaagacggatgtgatgggaacaaaaactgttactgcacctggcagtgtgaccatgactaacgctaacggtttgactgcatctgctgttgctgacaaacagactgcggttaagggagaagctatcacctatactgtgacttttagtgggacaactactgcagctacaaaagttatgtttacagccggaagcaactctactgttgatactgcaaagtgtgtggtaactggcaattgggtagcccaatccgccacacaggccaacattgctaccacaaaggatggcacaggcactgtgaccttcaaggtaattgcgaatggttctggttccgttggcgctcccactattgcagttgccaaccagtaaaagattttagtgtttaagagatggtgatttctgtcaccaaagggccccgaatgattcgcattcggggccctttctaaaaaaacaaattcccacctcaaagtgaatgaggtgggaatttattttacgagcttatggaaacttttgcttcatcagctgccgtaaaagaatttactgtgcaatgtcgctgttcacgtcgacataaatagcaacgataggcttgctgatattgttatcctcaaagacaacaaccacgttcgccttaccggtcacaccatcaaaggcgttcacgccaatttcagagccagcagtgttatcctctgcatctacgtaaacaatctgaacatcttcgtctacagccttagtggtcagaccagtgccgggatacacaccgtcggacacggaaccagcgccagtgtaataggagaggatctgtccagcttcgtcatactcctttacaaaaactgcggccgcgttatttgtagcggtgtggttggactcgggatagtagactgtgatatcgctggtcgcatagatgtcatcggaagcgacgtcgaaggaaaccaggtcgccttccttcaaagtgctgtcgttgtcaccctcgatcagtacggtcttctgtgtgctctcgtccacatcgacagtgtaggaagtataggtgtcgtcgttgacttttacagtgccattctcagaagaaacaatgccataaacagtatcactggatgcaccagagggcttgttggccagtgtcacataggccgccacgaccttgctaccgtcgctgtccatcatgtaggaatagtagccgtactgagccagatcaatgtcattcaaattccgaatgttgtaggcatagaaatcacccactgcggcaggctcatcatcaccaggaatggtggtcttgttgacaaagaggacaccgtcggaagcgactacctttttgtcaaaggacttggtatctttgtcgtacaagtcaggttttgccgtttcagcttgctgtgcttcaacaacggaagtaaccttaatcttgccgtcggaaacgtcagaatacttgataatcgcgccggtcttcagctttgcagtgtccttggagtccttatgaatctcaactgtggcctctgtgccatccgctttcatcattttgactttcaagggatcaaacgtgtcgccgatggcgccatccgcatcttccaccacagcgtactgcgttgtctcagttaccatctctgccgcataggcaattccgttaaccaaatacagcttaacggtttctccaatttggtttgcaggtgcagactgcaggaaatcagagtcgacagacttgttttgggcaatgttgtccagatacgcatcatacgttgttccatcgactgtgatctgcttcacgccgttataaccggtcagcttaccctctacggtttctgccttggttacagtggtataagcatcggaagcggttgcagaggtgttatacagtgtggtaacaagaacaatgtcgtcctttgcaacatccttatagatgtcgttgtcctcgatcttaatgctgccgacgccgttgttgagagaaaccttttcgttgtttaccgcagtaacccgagccagcttagactcaaccacgtaggctctggtgatatctccattctcgttgcagacaaacttaatggtgtcagcagaaacagccttcaggttgctgaaagcggtagcgacatcatcggcagaggtaccactggtagcacctacggttgacttagcaccatagttgacgttgagatactcgtaatctttcgcagctgcagccacatcgtagttcttatccccgaaccgaacggtgccggcttccttctgcgtctggagatcattcttcgtgatgttataaacggtggtagcgccggttacaaccacaccataaatggtatccttgttgtcgggcttattctttgttccaccggttccatccttaaacagaacgttaacctcttccccaatgtacttcaggtcaaaatcatacttgaagttcgcagtgaccttctcagaatcgttcacagaaccatagacctgaatttctccgtcgttcaggttgcagacgtcggcgttaccgttaaacgtaccggtaaaggtcttagcctcatacttgtcctccaggagggtgatcttgtcgctggtagtgccaacaaccttatcctggacggtgacaatggtctccagtttgccattctcgtcggtgataatggtggtcttatactccacctcataggcgttcatggcattccacaccatctgggccgcattgtcacgggtcagagcggcggaagtgtccatgctctccagaccctcgtacaggcccttctgggaggcgatcacgttgacgttagtcgcccaagcgttgcccacaaagccctcggtgttggcgttgtagcccaggctgaccagcagcatcttggccagctgggagccggtcacgttgccgttggggctgaaccggccgccgcccacgccggagatgatgccctgggccacgcaggactcaatgtagccctctgcccaggcggcgttggtgccgcgcacgtcgctgaaggtgggggtggtgttggtgctcacattgggctccttaccaccgttcagcgccacgcagatcatcttggtgatctcggaccgcttaatgttcccctcgggcttataggacccgtcgggatacccgccaatgatgttcagcgcagtgcacatattgacggcctcggtgttctcgatcttgtcctgatccgagaacgccgccccggcgcccatgaccatgacagacagcatcacagccacacagagcaccaggctcagaaccttcttctggggga

SEQ ID NO: 2267 - DNA, 5602 bp, KLE1738
cacactcaatcttttatcacgaagtcatgattgaatcgcgagtggtcggcagattgcgataaacggtcacattaaatttaacctgactattccactgcaacaactgaacggactggaaacactggtcataatcatggtggcgaataagtacgcgttcttgcaaatcaccagaaggcggttcctgaatgaatgggaagccttcaagaaggtgataagcaggagaaacatacgaaggcgcataacgataccactgaccctcagcaatcttaaacttcttagacgaatcaccagaacggaaaacatccttcatagaaatttcacgcggcggcaagttgccatacaaaacagggtcgccagcaatatcggtataagtcaaagcacctttagcgttaaggtactgaatctctttagtcgcagtaggcggaaaacgaacaagcgcaagagtaaacatagtgccatgctcaggaacaaagaaacgcggcacagaatgtttataggtctgttgaacacgaccagaaaactggcctaacgacgtttggtcagttccatcaacatcatagccagatgcccagagattagagcgcatgacaagtaaaggacggttgtcagcgtcataagaggttttacctccaaatgaagaaataacatcatggtaacgctgcatgaagtaatcacgttcttggtcagtatgcaaattagcataagcagcttgcagacccataatgtcaatagatgtggtagaagtcgtcatttggcgagaaagctcagtctcaggaggaagcggagcagtccaaatgtttttgagatggcagcaacggaaaccataacgagcatcatcttgattaagctcattagggttagcctcggtacggtcaggcatccacggcgctttaaaatagttgttatagatattcaaataaccctgaaacaaatgcttagggattttattggtatcagggttaatcgtgccaagaaaagcggcatggtcaatataaccagtagtgttaacagtcgggagaggagtggcattaacaccatccttcatgaacttaatccactgttcaccataaacgtgacgatgagggacataaaaagtaaaaatgtctacagtagagtcaatagcaaggccacgacgcaatggagaaagacggagagcgccaacggcgtccatctcgaaggagtcgccagcgataaccggagtagttgaaatggtaataagacgaccaatctgaccagcaaggaagccaagatgggaaaggtcatgcggcatacgctcggcgccagtttgaatattagacataatttatcctcaagtaaggggccgaagcccctgcaattaaaattgttgaccacctacataccaaagacgagcgcctttacgcttgcctttagtacctcgcaacggctgcggacgaccagggcgagcgccagaacgttttttacctttagacattacatcactccttctgcacgtaatttttgacgcacgttttcttctgcgtcagtaagaacgtcagtgtttcctgcgcgtacacgcaaggtaaacgcgaacaattcagcggctttaaccggacgctcgacgccattaataatgttttccgtaaattcagcgccttccatgatgagacaggccgtttgaatgttgacgggatgaacataataagcaatgacggcagcaataaactcaacaggagcaggaaagcgagggtatcctacaaagtccagcgtaccataaacgcaagcctcaacgcagcgacgagcacgagagcggtcagtagcaatccaaactttgttactcgtcagaaaatcgaaatcatcttcggttaaatccaaaacggcagaagcctgaatgagcttaatagaggccaaagcggtctggaaacgtacggattgttcagtaacttgactcatgatttcttacctattagtggttgaacagcatcggactcagatagtaatccacgctcttttaaaatgtcaacaagagaatctctaccatgaacaaaatgtgactcatatctaaaccagtccttgacgaacgtgccaagcatattaagccacttctcctcatccaacgcgtcagtttttgacagaatcgttagttgatggcgaaaggtcgcaaagtaagagcttctcgagctgcgcaaggataggtcgaattttctcattttccgccagcagtccacttcgatttaattcgtaaacaagcagtagtaattcctgctttatcaagataatttttcgactcatcagaaatatccgaaagtgttaacttctgcgtcatggaagcgataaaactctgcaggttggatacgccaatcatttttatcgaagcgcgcataaatttgagcagatttgtcgtcacaggttgcgccgccaaaacgtcggctacagtaacttttcccagcctcaatctcatctctctttttgcgttctgcttcaatatctggttgaacggcgtcgcgtcgtaacccagcttggtaagttggattaagcactccgtggacagatttgtcattgtgagcattttcatcccgaagttgcggctcattctgattctgaacagcttcttgggaagtagcgacagcttggtttttagtgagttgttccattctttagctcctagacctttagcagcaaggtccatatctgactttttgttaacgtatttagccacatagaaaccaacagccatataactggtagctttaagcggctcacctttagcatcaacaggccacaaccaaccagaacgtgaaaaagcgtcctgcgtgtagcgaactgcgatgggcatactgtaaccataaggccacgtattttgcaagctatttaactggcggcgattgcgtacccgacgaccaaaattagggtcaacgctacctgtaggaagtgtccgcataaagtgcaccgcatggaaatgaagacggccattagctgtaccatactcaggcacacaaaaatactgatagcagtcggcgtgtgaatcattagccttgcgaccctcggcagcaagaaccatacgaccaatatcacgaaaatagtcacgcaaagcattgggattatcataaaacgcctctaatcggtcgtcagccaacgtgagagtgtcaaaaacgataaaccaaccatcagcatgagcctgtcgcattgcattcatcaaacgctgaatagcaaagcctctacgcgatttcatagtggaggcctccagcaatcttgaacactcatccttaatacctttctttttggggtaattatactcatcgcgaatatccttaagagggcgttcagcagccagcttgcggcaaaactgcgtaaccgtcttctcgttctctaaaaaccatttttcgtccccttcggggcggtggtctatagtgttattaatatcaagttgggggagcacattgtagcattgtgccaattcatccattaacttctcagtaacagatacaaactcatcacgaacgtcagaagcagccttatggccgtcaacatacatatcaccattatcgaactcaacgccctgcatacgaaaagacagaatctcttccaagagcttgatgcggttatccatctgcttatggaagccaagcattggggattgagaaagagtagaaatgccacaagcctcaatagcaggtttaagagcctcgatacgctcaaagtcaaaataatcagcgtgacattcagaagggtaataagaacgaaccataaaaaagcctccaagatttggaggcatgaaaacatacaattgggagggtgtcaatcctgacggttatttcctagacaaattagagccaataccatcagctttaccgtctttccagaaattgttccaagtatcggcaacagctttatcaataccatgaaaaatatcaaccacaccagaagcagcatcagtgacgacattagaaatatcctttgcagtagcgccaatatgagaagagccataccgctgattctgcgtttgctgatgaactaagtcaacctcagcactaaccttgcgagtcatttctttgatttggtcattggtaaaatactgaccagccgtttgagcttgagtaagcatttggcgcataatctcggaaacctgctgttgcttggaaagattggtgttttccataatagacgcaacgcgagcagtagactccttctgttgataagcaagcatctcattttgtgcatatacctggtctttcgtattctggcgtgaagtcgccgactgaatgccagcaatctctttttgagtctcattttgcatctcggcaatctctttctgattgtccagttgcattttagtaagctctttttgattctcaaatccggcgtcaaccataccagcagaggaagcatcagcaccagcacgctcccaagcattaagctcaggaaatgcagcagcaagataatcacgagtatcctttcctttatcagcggcagacttgccaccaagtccaaccaaatcaagcaacttatcagaaacggcagaagtgccagcctgcaacgtaccttcaagaagtcctttaccagctttagccatagcaccagaaacaaaactagggacggcctcatcagggttaggaacattagagccttgaatggcagatttaataccagcatcacccatgcctacagtattgttatcggtagcaagcacatcaccttgaatgccaccggaggcggctttttgaccgcctccaaacaatttagacatggcgccaccagcaagagcagaagcaataccgccagcaatagcaccaaacataaatcacctcacttaagtggctggagacaaataatctctttaataacctgattcagcgaaaccaatccgcggcatttagtagcggtaaagttagaccaaaccatgaaaccaacataaacattattgcccggcgtacggggaaggacgtcaatagtcacacagtccttgacggtataataaccaccatcatggcgaccatccaaaggataaacatcataggcagtcgggagggtagtcggaaccgaagaagactcaaagcgaaccaaacaggcaaaaaatttagggtcggcatcaaaagcaatatcagcaccaacagaaacaacctgattagcggcgttgacagatgtatccatctgaatgcaatgaagaaaaccaccattaccagcattaaccgtcaaactatcaaaatataacgttgacgatgtagctttaggtgtctgtaaaacaggtgccgaagaagctggagtaacagaagtgagaaccagcttatcagaaaaaaagtttgaattatggcgagaaataaaagtctgaaacatgattaaactcctaagcagaaaacctaccgcgcttcgcttggtcaacccctcagcggcaaaaattaaaatttttaccgcttcggcgttataacctcacactcaatcttttatcacgaagtcatgattgaatcgcgagtggtcggcagattgcgataaacggtcacattaaatttaacctgactattccactgcaacaactgaacggactggaaacactggtcataatcatggtggcgaataagtacgcgttcttgcaaatcaccagaaggcggttcctgaatgaatgggaagccttcaagaaggtgataag

SEQ ID NO: 2268 - DNA, 4428 bp, KLE1738
aggataatctcttattatcacttattgtggcatcaaataattactatcctttgttacaagcggtaaaataaggtctgatcagactgacaggagtgggagaaatatggaacgccaaaaatatgatgttgcggtttcttacgccagtgaacagcggccttatgtggagcggttcgtcgcacggctgcagtcccaaaaaatgcgtgtatactatgaccgaaacgcacaggctaagatggtcggaaaaattctggatcaggaattgcacaggatctatcttcaggaatccaattgctgcatcctgttcctgtcaaacgcatatgttgaaaagcctgttacacgctatgaatcgcagatcattctctctgagaaccttttcaaggaaaatttcatgtatattttcaagtttgatgatgtaacgcttccggggttgaatcgcaattttgtttactcaagcgcagcggaattccctgaaccagaggcgtactccaattttatatatgaagtaatacggggaaaaaagccgaaagatgactctggcacctttttatatgagtcgctcgcagatggactcgttcagatcctggatcgctgcgcatcccaatacaagtttacgcttcgctctgaccggcagtccaataagctgctcctacgtctgcgatccggggctgccgtgctgctgcaagtccaggtgggacagctcctcgggaaaagcggcgtatgtctgtggatgcacccgggaagccgctcctgtgacgaccacgcctatcagggctgcgtcacatggtctgccttaaagtgccagtatcgcctggaaaaccgagggctgctgctggatctgacgccggagatagagtttccctctttagccggcctgcttgaacggctggatagggaaattcagacgatactcggagtgtcggcatgaagctgaacgattattcaagcttgctctcggagcttagaaaaggagaacggcaaagggtctatattttgaccggggagaggggcctgggaaaacacagcgttttatccgccgcagccgaaaccatcaaagagaccgccccagatgcgaccatcctttcggtccatccagacgcattcagtttttccctctggcccatggaggaggccctccggcaaagcactccagatgccgctttgcccagccacgagatgaaagacggcttaaattatccggaacaattgattcggagtattttggaactgtgcagcggaaaaaaacgtactattatctttttgaaccggctccagtcctttaacgatgatctatggtcgtttactaccaagctgctccgcctgcttttagatccataccgcagctttaacgtctgtttctgttgctgtctgcacaccgacggcgttttgcgcagccaatccggtacccaaacccgcagtgccgaccagctgatcgggcttttctcccggtatccgcagagtacatgctacctgtacttccacccctggtctagagaggggctccaacgctttttggagaatgaactgtttcagggcaagctccgcatggctccggggcagaggggcctgttgcttgacgccgccatgggaaacccagccacgctgatcaacctgaccgagcgcatgaaggcccgaggccttctttatgaggaaaacggattctactgctgcggcagtatagatgggacggtactgctcacctgcggccctgttccggcgacagaggagtatacgcggatggagcacccgctacaggaattgctccgcggctccagcgtcatcggcgtggaatttgaggcccagctcctttccgacccgttgggtttctgggcggtaaaggacaagttgagacgactcctctccatttcaaggatcatccaacgcaaggtggacgatctgtacgaattcgagagcatattcgccagactctccatccgcgatcttgtatccaaagaagagagcgtcctctggaacagccggttgggcgagtatttctggaagctcagccagcggcagataactgagggcgcggtcagcgccagtctgaacagtctgaaaaagagcgcgttttactacgatgaggccatgaaccgcgcacaggccatgcagctgtatgagcgcctgagcatggaactcatgtccatcatgcaatacagggacgcggtcaaggtgctccgcaggatgcgtgatctttgtgaacttgtccccgatcttcgcacaccgaacgatttgaaccgcacctggcagctggagggagactgctaccgctattgttctgatttttctaaggcgatcaccgcatacgagacttttttggagcgtgcaaaactcaccaaatatgaacggatggacgcccaatgcagctattgtgttgtcctgtatgaatcgggagagatctctcggccgctggaacatctacggacgctcttatccgaattgcaaaaagagaccggtccccaggccgcgtccattctggtccgcacactgtcctgcctgacctcgatagaagagacgctctgcgacccaatgcatgaattccattttaacgcggccctggacattgccaagcggtatcatttagaggacgagtactatgtccttttgagaaaatctctgattgtgcacaagggtgtttatggaatcagcctgatggagagcgcacgggtgtattttgagcggatagggaatcagaaggagctggcaaggaccttgtgcaaccttgcggcggagcttctgctccacggagatctggagcaggcaaggagcaattaccagcacagcgccgagatccttcgcagtttcggagcggaaacaatctatgtccccatcaatggcctgggggattattggtgtctgagaggcaattttgaacgggcactttccctttttgaagaggcttaccgagaagagtacgatgcgtttaccagaatcgccatccgaatcaatcaggcgactgcccacagaaagctcggacattacgacgccgcagcggagcggctggcgcaggcagaaaagatttcaaacagcggagatgccgcggaatatgcgatcttgcttccccacctcctcatcggtaaggcactgctcctttatgacagaggggaactggaggaggtctacccgcttttcctgaaatatatccaggaggatcccagctttggccgccgtcggctggcccttgcgggacaatacattcaaaagatctgcgcttattttcagcgccctgtcccggatggcgtagatgcttttgcaaaagcgacctcacctgctgacgagcgcctcctccggcacgggatcaccctgattcgattctcaatcaccgagtagcaggatatctccgcagggcggattccaaaactgcgttcagcagatcggcataggacatccccctccgggcggcacaaaactcaaatgtaccgccccggttcatcgaggggataggggtcacttccagcagatacggaacaccgttgtatagtttcaaatcaatgcgcgagagatcacagcactggaatccacggtggacccgcagagccatatcgatgatcgcttggtctgtctctctcccaaatgatctccactcggtccggtggtttccgtgctcttttttctccgcagtgtaaaacggcatgatgccaccatcctgttcgcaatactctacgattcccaagacctctgcctctgcaccggttcccaggatagggaccgccagttcatgcccaccaatatattcgtcacagcgcacttcctgcttgtaagtccgcacgatccgtccaacagcggccaagaactcatctttattttttaccagcgacagacccatgctagtgccttcccggttaggcttcaccaccaaaggatatgtgatcccggcctgggcggagagagtctccagttcgtccagcgtgtgaaactgcggctgataaaggaaccccttcggcgtatgtattcccaagctttctgcatagagcatggttatatgcttgtccaaagtgaggaccatggcaaaggcgtcactccctgtatagggaagatgaaagatctcgcaaagcgccggcacgatcccctcccgatttctggacagaaagccctcgccaaaattcatgatgatatcaatatcttttagtttatcctcgcgaagcatgcgggcaaagctgtggggcgccccaacgggcaagacataatgaccggactgctcaagcgtgttttggagatactgcatatcgctcagatagttaaaatcacagaaggtcacatcacttgcttcaagcccataatcttctctgatatcaaaaacaagaccaatacgcatagatcatccctccctacctgccgccgcacaagaacgattcataatggggatgacttcccgttcatgtcttatgctggcttcagaaactgattaaacgattgataataagagattatcct

SEQ ID NO: 2269 - DNA, 4289 bp, KLE1738
tggtagacgcctggagccgccggcgcggtaaagagtccgctggcactgaccgcgttatccgccgaggaccaggttacatcgccggggagggtgtccatgggataccagccggtgtccatggcggaggccacgcactgggtggtggcgccgggcagaagggtcaggcttttgggggtgacgtagagggaaccggctgtcccggtggggttcaggttggacagcaggaagatggcgttggaaacagagcggggggttccctctgaggggctgttgatggtagaggatgtaccgaagtcgggatacgtagaaaccagcgtggtagaaccgccgccgtccaaaagaaccgcgttttcacagcccagctcctggagccgctgggccaccatttgaatggtggcgccgacgctcaggccgctctggcggccgtcgatggtatagaagacaacgctgccatccggtttcactcccaccgcggtgcggggggcggaggccccgtcggagatgctggtgtccaccttgccgtctttcagaatccaatacatggcgcccacagcgtgctggacgttgttccagcgggtgtcttcgctggagatgttgatgtccactgtatcgcccacctggagggagcgaatggtctcctgaagccattccccgcttttgttggagatagacatgatgaacttgccatcgggaatggcggtggcgccggaggcctcgatgacctgctccacggtgcaggagacggtgccgccgatctttaattgatcccccggggtgttgggggcgaggatcacatccacccccttttgggtgttcttggtggtgttgccaaagtcatcggtaaacagatagaagccggtgttggtgcggatcttgttgatgtctgcgatcttcaaggactgccccttgaaatccgccatcaggctcaggttaggggtgccgatgacggcagagccgtcggcgttaaagccgatggcgtggaggtaggaggcggaggagcggaggacgccgtccgtgatcacaatgcccaaggggtctcctgtggccatgacaaagtagtcaccgttgatgccgctgagaacgcggcgcccgttcttttccagggccttggccatggaggtgacggtctgcttgtccgggatggagctgccgaagctcaccacgggggagatgctgtcagagggcttgtaagtgacataattttccgtccgcaggtcggaacgggaggaactccacatgacttcccgcgtaagcgtggtgtcgtcacaaatgtccaaggtgtatccatagattttcccgcccaaagcatccgaggccagagccgtggaacagagcaggaccgcgcagagcgccagtgcagtgattcgtcgaaggatggatttcataagcggtctcctttgcgtcttgtgttggttggatttttgacaataaaatggttgcgtaggatttttttattgtaccataggaggaaaagaaatgcaaagtgaagaaggacgaagaggccaggaagaagctggatggcgggaagcagtctctgttcccggggaacagaagggaagcttggacttgactctacaataatagtagactggataatgggcgggcaaaggagatggtgagagatggaacaagcacccaacgcgctgaccaagggaagtgtggtcaaggcactggtgacctttacgctgccgtttttgctggccaatgtgctccagtccctctatggggcggtggacctctttgtggtagggcagtactgcgacgctcaaagtgtggcggcggtgtccacagggacccaggtgacccagattgtcaccagtttggtgacgggactgaccttgggagggaccatcctcattgggaaatacaccgggatggagcggtgggataaggtaaaaacggccatagggaccaccctgtccattttcgcgttggtggccctggccctgacggcgctgatgctgctgtttgaggcgccgctgctgactctgctgaataccccggcggaatcctttgaggcgaccatggaatatgtggccatctgtgcgtgggggaattttttcatctgcggctacaattcgctcagcgccgtgctccggggctacggggactcagtccgtcccatgtattttgtgggggtggcctgtgtggtcaatatcctgctggattttcttttcgtcaagtacgtgggcctgggggcaggggggaccgcgttggcgacggtgctttcccagggggtcagcatggccattgggattgggtatctgaaaaggaagcggtttctctttgattttaagcccgccagctttcggatcgaccctgcgatggccaaggaattggccagggtgggtatccctatctcctttcaggagctcatggtacggatttccttcctttatctcaccgctgtgatgaaccactgcggggtgtatgccgcggctgtggtgggcattgggagcaagtacgacgtgttttccatgctctctgcgacctccatcgccaatgcgctggcggccattaccgcccagaacatgggggcagggaagccggaacgagcgaggaaatcgttgtggtacgggctgagttttgcccttcttgccgcctgcgccttctggacctgggcacaggtgagtccggagacgatgattgccctgttttcagaggacagtggagtgattgcagcgggggttccatttttccgggcatgcagttatgattatattatggtggcctttgtgttttgcctcaacggctacctgaacggacgggccaagaccctttggaccatggtcagctgcaccttcggcgcactgtgtctgcggattcccttggtctggtttgtgagcggccatttttcccaggacctgggtatgctggggaccgtggcgcctgtggtgtcggggattatggcactgtatactctgctctatatactttgggaggggaagcaggatggcaaaagaaaatcgagagctctttcccatcggtgaggtggcaaagatgttccgggtcagcgtagggactctgcgccattatgagaagatcggcctcctggcgccggaatttgtggcgccggatacaggataccggtattacagcacccggcagttggagtgcctgaataccatccgctatctgcgggtgctggaaatgccgttggagcagatacgggaatttctccaaaaccgggaagtggaaaagatacaggagatgctccagcagcagaaagaggtggttgtccagaaacagcgggcgctggagattgtgcagcgaaagatagaaaaccgcttgcggcagattcaggatgcgctggcctcagagctggatgtgatccggcaggtcgatatgccggcccggcggattgcctggcttcacgacaccctgacccccaaaacctatctggatttagagccctctattcggcagctggagcagcctgcgcaggagtctgtggtttttctggggaaggtaggcgtgggaatctcccgggcgcggctggaggaagggacgtacacagaatatgaccgggtgtttcttctcctggaccaggaagatgtctatcaggggaaagaggaagcgcttccgccagagcgctgcctcaccgtgcgctttcggggcagccatcgggaggcggagggatactaccggcgtctgatggagtatattcggcgggagagattggagattcttgggccctcaaaagagatcacaatgattgacgatgggatgaccagcgacacagagaagtttgtaacagagattcaaattcccgtgggaccgtctgaaggggagacaggatttcgaaaaaaagagaaagaaaatgaaaaataagggttgacattccaggggaggcgtggtattctatcaaagctatcgcgagacacgggccgacaagaggtcaggaaatgaaaaaagtttgaaaaaaacggaaaaaatttcttgacaaagcgtcgaagctgtgataaaatacagcttaccccgcagaagcggtgtgcaccttgtaaattaaacaacgtaagtaagaaacacgaagcaccaaaacggacaagtagaagttgtccatgaagcttaaggctttgtggggcaacgttttatttctttgaagctaatgattagcgatcaatgaattgatttgaatagcggcgagagccgctgtttagataccattttattgagagtttgatcctggctcaggatgaacgctggcggcgtgcttaacacatgcaagtcgaacggaggacccttgacggagttttcggacaacggataggaatccttagtggcggacg

SEQ ID NO: 2270 - DNA, 4231 bp, KLE1738
gcagcagcaccgtccccaccgcccccagcaggagggagaggacaaagacccgccggcgccggcggctggtccggatcactacgttctcattctgacggtccagttccatgaagtcgtgaatctgcatcctgcggatgcgtctcctgctccggcccagggccagcaggtagacaagcagcacgtagagcagcgtcatccccaccgcctccagggagaaggcaaaggagagccggtactccaccccaaacagggccagcatgatggcccgaaggatttgaaacatcaggtttcccagcaccacccccagcaccagggcaacggcccctaccgccagattctccaggaaaaacagccgggccacctgccggtgttccaagccgatgaggaggtaagtccccagctcccggcttcttcgggtcagcatgaaccgggtgatataggccaccagccagcccagaatcagcaccaccgccacgctggccaggacaataaccaagggcaggctggagagcttggcggacaattccgctatctcccgggagaacaccagcccattgaacgcgtacatcagcgccgtggcaatgacaatggtgacaaaatagaccaggtaatcccgggcctgccgccgggcattgcgccaggagaggtcacgtaacgtcactgacgtcaccccccagcaaagccagcacgtccaggatctcatggtaaaaggccgggcggtcccgttcgccccggagaagctcattgaacagccgtccatccttcaggaacagcacccgggaggcatagctggcactgtacggatcatgggtcaccattaaaatggtcgctcccagcacccggttgagcctggtcatgatctccagcaggtttttggatgccttggagtccagcgcccctgtgggctcgtcggccagcagcagggactggcccgctaccatggcccgggcgcaggccgcccgctgcttttgccccccagagacctgatagggaaacttatccagaatctccccaatctccagctcctccgcgatggcccgaaccctctgctggacggagtggggatcggcatggttcaggctgagggccaggccgatgttctcctccagggtcagggtgtccaaaaggttgcaatcctgaaagacaaaccccagccgttcccggcgaaactgggccagctgacggggggagagctgggcaatgctctgtccatccagcaggatgtccccggcgctgatggtgtcaatggtggagatgcagttgagcagcgtggtctttccgctgcccgaggcccccataatggcgatgaacgccccatcctccacggtaaagctcacccggtccagggcctttgtcacttggttctggctgccatagtatttctcaatgttctgtacttgcagcatgatacccgcctcctttgctgatagccccagcatacagcaaatgcggcgccggtggtatcgcggtttccccatcttatcttacagttttgtaagcttttcctgggcgggaaaggtgagcagcacctgggtgcccaccccctcctccgaccgaatcgccagggaaatctccaaggcatccgccaatttcttggccagatacagccccatccccgtggaaccgccccgcaagcggccattgctgccggtaaatccccggtcaaaaacccggggcagctcatgggccggaatgcccatcccgttgtccgacacggtcagttccacccgtttctcctgtcttcgggcggacaagataatcacagggcgtgccctccggtatcgggctgcgttctgcagcagctgccccagcaggaaacacacccatttcctgtcggtataaaccacaaagtccaggtcacagagctccacgctcaccccgttttgcaggagcaaagcccgatgcgcctgcaccgcctggttcaccaggtccgacagactggccgggtgaatgagaacgtccttctccggattctccgcccgggcgtaaaagagcgcccgttccacatgggctccgatctggtccagttccgcctccagctttcgccgggtgtctgccccgctccgccgggccatcaggcgggcagcggtgatgggggttttgatctcatggacccagcgttccacgtattcccgatagtcccgctgagccgcctgggcctctgagactgcgccgatcatcgcctggccagaccggcgggttatgtccagcaacttgcgctcatagagccgttggggcttgggggcacactctgggaagagatatttctggtccaatccctccagcagcctttcccaggtctctatggtccggcgcatccgccgaaaggcctgggcctgggccgccaaaaagaccagaaacaaagccgccagcagcaggataagaacccctggggaagtccctgtggccagcagaatccctgctgccagcaccgtgcagctcccccacagcaccagacgccccagccggtcagagagaaattcaagcaccgtcatattgataccccatgccccggcgggttcggatcattcctggcacacccagtgcctccagcttgccccgcagacgggtgacattgacgctgagggtattgtcatcaatatagatctgactgtcccacagagcctcaatcagatcagcccgggagacaatctctccggcgtgggtcatcaaatgggccagaattctcagctcattgcggctaagctctgccgtcctcccatctgcggataccgtccctctggtgagggacagccgcaggccaccggcttccaccacatccggttccgccggtccacctccacgccgcagcaccgctttgacccgggccagcagaatggggatattgtacggcttggtgatatagtcatcccctcccaggctcagggcccgcagctcatccatcgtggaatttcggctggtgaccaggatgatgggaaccccacaggtcttccgcaggtccgcacacagggagaagccatcccggccgggcaagcccaaatccagcagaaccaggttcgcgccaaaggaccgcacctgcgccaccacctccgtaaactctgttaccgcctggacctgatacccctcattttccagcaagagaaccagctcctcccgcatggcgggatcgtcttctacaatcgtaatcttttgcatctctgaaaccgccttggcaaagaaagttgagaaaatagcaaaaagtcctgaaccaaacggtttcaggactttctggagctgctgggcggatttgaaccgccgacctcatccttaccaaggatgcgctctaccgactgagctacagcagcaaatatggcgacgcggaagggacttgaaccctcgacctccggcgtgacaggccggcgttctaaccaactgaactaccgcgccatatttggcaggggcagaaggacttgaaccctcggcacgcggttttggagaccgctgctctaccaactgagctatacccctatatggtgggccttcacggactcgaaccgtggcccgaccggttatgagccggttgctctaaccaactgagctaaaggcccatttccggtttccataggctttatacaaacctggtcgcccaggaacttggtaaagtggcgccccctgtaggactcgaacctacgacaccgcggttaacagccgcgtgctctaccgactgagctaaggaggcagatcggaggagagttcctcctccaaagtgttggcgttacctattttcccggttcgtctccaaacaagtatcttcggcgcaagtgagcttaacttccgtgttcgggatgggaacgggtggaccctcactgcaatcaacaccaacttactcttttgtgaagctgtggcaacatccacaccctcaaaaccgaacaaagtaaccgccataccccaagcaagcgcctgcacttcttactcttaacctgagactcaggtcaagccctcggctgattagtaccggtcagctccatacattactgcacttccacctccggcctatctacgacatagtctctgtcgtgccttactcctcgaaggatgagagatcttatcttagggaaagtttcacgcttagatgctttcagcgtttatctcgtccgcacttagctaccctgctatgccgttggcacgacaacaggtgcaccagaggtgcgtccatcccggtcctctcgtactaaggacagcccccttcaaatctcttacgcccgcaacagatagggaccgaactgtctca

SEQ ID NO: 2271 - DNA, 1774 bp, KLE1738
cgccccttcctgaagaagcggcgggtctgacgaaaatgggatctgttttactctgctccgtccgcctctgaactgggagaggacgccagcttgctgccgcactgggagcagaacacagcctcagcagagagcaccgcaccgcaggcgggacagacagcagcgggggctttctcgactttgacgccgcagtgtgcgcaaaagttgtcctcctgggacagtgccgcaccacagctggaacaggtaggggaaagggcatcctcttctgcctcttccccttgacggctggcctcaatgtcggctctcgcccgggcaatgacttcccgggcggcctgaatggaggaatacagggccatgatctcgtcgtcgaaggtctctcctccgtccagcttgtccaggaccagttcgccgatattcagggtaaactcgtcgatctttttttcctcgttgttgatcttgaggctcagttttccgttttcaatggcggtgttggccttgctggcggcttccgcagccagggagttgagcttatcacgcaatgccatgggcattcttcctccttacagaactggggggtgagagggaccgatcagaaataggccttgatggcctcggtggccagggcgatatcggcactgatggtgatggtaaacttcaccttgttggtgtcggagaaacgatccagccaggccaggaattcctccacctcaggggagtcgggctcggaggggatgattctgcacaggctgtcgatgaacacgtgggttaaatcgtagttggaggcatacatgccgctgataaagcccttgaggaaggtaaagttgtcggcggcgaagtcactggactccaccagacggactttggggctgacatcataaaccagctttttgccgatttcgacgcagaccacgctgccgccctcgttgtcagcggcatgattgatcatatcaatgagctgcttggttttaccggtaccttttgcgcccataattactcgaaccatgaataatcactccttcttgatccagaaaagaataaacttcctgttgggttcatgttaccataccaacgggaaaactgcaatgggatttatcagatttttataaattccttccaaagaaattctcttttttgtgcttttctttcgctgggggtcccggggcccaagagcccttaggacggtcccttggacagcaggtcctcccgccgggccgcgaagccgggcttacccagcagggcgaacatgttggttttataggcctccacaccgggctggttaaagggattgacccccagcagatagccggacaggccgcaggcgtattcaaagaaatagaccagctgccccgcccagtagggggtgcgctcctgcacggtgagcaggaggttgggcacgccgccggccacgtgggccaggacggtgccccgccgggcctgttcgttgacgaaccgcaggtcctttccccggagaaagtccaggcccgagtggtcgccgggcactgggtccagcaggcaggaggactggggaacggtgaagcgcaccacggtctcaaacaggttccgggcgccctcctggatgtactggcccatggagtgcaggtcggtggtgaactccacgctggcggggaacaccccctgcccgtccttgccctcgctctccccgaacagctgcttccaccactcgccgaaagcgcgcaggtggggctcgtagcaggccagcagctcaatgagcttgccctccgcgtacagggcgttgcgggcggcggcgtactgccag

SEQ ID NO: 2272 - DNA, 668 bp, KLE1738
cgctgcgacttcaccccgtattcgacgctcccctacccctgccttcggcaagcccaagcttcggttaactgcttagccccgttatattttccgcgcaagaccactcgaccagtgagctattacgcactcttttaatgtgtggctgcttctaagccaacatcctggttgtctgggcaatctcacatcgttttccacttagcaattatttgggaccttagctgtgggtctgggctgtttcccttttgaccacgagacttatctcacgtagtctgactgctatgcatcaattagccggcattctgagtttgatagggttcagtaactttatcagcccctagcccattcagtgctttacctccggtaatctaacataacgctagccctaaagctatttcggggagaaccagctatctccgggttcgattggaatttcaccgctatccacaggtcatcgccggtcattgcaacgaacgtgcgttcggtcctccatggagttttacctccacttcaacctgcccatggataggtcacccggtttcgggtctattgccaccaacttcatgcgcgctattcacactcggtttccctacgccttcggtactgaataccttaagcttgctgataacaataactcgccggaccattctacaaaaggtacctcatcaccc

SEQ ID NO: 2273 - DNA, 2522 bp, KLE1738
ccgctatttccaagtgtcagctttcattcgataaggtggctacggaatttcaaccgtatgtgcatcgactacgcctcgcggcctcgccttagctcccggctaaccctgggcggacgaaccttccccaggaaaccttagattttcggccattatgattcccacataattctcgctactcattccggcattctcactcgaatacagtccaccgctgctctcgctgcgacttcaccccgtattcgacgctcccctacccctgccttcggcaagcccaagcttcggttaactgcttagccccgttatattttccgcgcaagaccactcgaccagtgagctattacgcactcttttaatgtgtggctgcttctaagccaacatcctggttgtctgggcaatctcacatcgttttccacttagcaattatttgggaccttagctgtgggtctgggctgtttcccttttgaccacgagacttatctcacgtagtctgactgctatgcatcaattagccggcattctgagtttgatagggttcagtaactttatcagcccctagcccattcagtgctttacctccggtaatctaacataacgctagccctaaagctatttcggggagaaccagctatctccgggttcgattggaatttcaccgctatccacaggtcatcgccggtcattgcaacgaacgtgcgttcggtcctccatggagttttacctccacttcaacctgcccatggataggtcacccggtttcgggtctattgccaccaacttcatgcgcgctattcacactcggtttccctacgccttcggtactgaataccttaagcttgctgataacaataactcgccggaccattctacaaaaggtacctcatcaccctttaacgggctttgagtgcttgtaagcacaaggtttcaggttctctttcactcccctcccggggtccttttcacctttccctcacggtactgctcctctatcggtcatcaggtagtatttaggcttggagggtggtccccccggtttcccacagggtttcacgtgtcccgtggtactctggatccagtccactaagaaatcgttttcgactacagggctctcaccttctgtggcgggccttcccagacccttcgtctaaccattcctcacttcttgactgtccgcaaccccagtgaataaatccactggtttggcctcttccgcgttcgctcgccactactggcggaatctcggttgatttctcttcctcgccctacttagatgtttcagttcaggcggttccccacgtacgcctatttgattcaacgcacgctgacagagtattgctctgccgggtttccccattcggaaatctccggatcgacggttatttgcacctccccgaagcttatcgcagcttgtcacgtccttcttcggctcctgatgccaaggcattccccttgcgctcttttcagcttgacctactttcttgtgaacaagaaaggtctcgctctggttctcatgagttcgaattatgcaggcttcagagttctttgaaattgttcgtgttacccttaaaaagttccacaaaaatttgttgtttccctctgttgcttgctcttcatactttggttactttgttcagttttcaaggtgcggttctggtctctctcgaaaccagattcaaacacttagcaatcctaaatgcttgaatctaacttcagactatccagttgtctcattttcatcttcgtgaaaatgagtggtgggcccaagtggactcgaaccaccgacctcacgattatcagtcgtgcgctctagccagctgagctatgggcccattggtggagataaacgggttcgaaccgttgaccccctgcttgcaaagcaggtgctctcccagctgagctatacccccatccatctccagggcgtgcgccctctaaattaaacaacgtaagccgacaccccgcacccaacgtctgaccttaggacactacaaatagccctcagactacttgagttctccttagaaaggaggtgatccagccgctcgttctcgaacggctaccttgttacgacttcaccccaattatcgaacccaccttcggccgcgccccccttgcggttaggctacggacttcgggtgttcccgactctcatggtgtgacgggcggtgtgtacaaggcccgggaacgtattcaccgcggcatgctgatccgcgattactagcgattccaacttcatacaggcgggttgcagcctgcaatccgaactgggacggcttttaggggtttgctccacctcgcggtcttgcttccctctgtttaccgccattgtagtacgtgtgtagcccaggacataaggggcatgatgatttgacgtcgtccccaccttcctccgttttgtcaacggcagtctcgctagagtgctcttgcgtagcaactaacaataggggttgcgctcgttgcgggacttaacccaacatctcacgacacgagctgacgacaaccatgcaccacctgtcaccacagtc

SEQ ID NO: 2274 - DNA, 1509 bp, KLE1738
atgagaaccagagcgagacctttcttgttcacaagaaagtaggtcaagctgaaaagagcgcaaggggaatgccttggcatcaggagccgaagaaggacgtgacaagctgcgataagcttcggggaggtgcaaataaccgtcgatccggagatttccgaatggggaaacccggcagagcaatactctgtcagcgtgcgttgaatgaaataggcgtacgtggggaaccgcctgaactgaaacatctaagtagggcgaggaagagaaatcaaccgagattccgccagtagtggcgagcgaacgcggaagaggccaaaccagtggatttattcactggggttgcggacagtcaagaagtgagaaatggttagacgaagggtctgggaaggcccgccacagaaggtgagagccctgtagtcgaaaacgatttcttagtggactggatccagagtaccacgggacacgtgaaaccctgtgggaaaccggggggaccaccctccaagcctaaatactacctgatgaccgatagaggagcagtaccgtgagggaaaggtgaaaaggaccccgggaggggagtgaaagagaacctgaaaccttgtgcttacaagcactcaaagcccgttaaggggtgatgaggtaccttttgtagaatggtccggcgagttattgttatcagcaagcttaaggtattcagtaccgaaggcgtagggaaaccgagtgtgaatagcgcgcatgaagttggtggcaatagacccgaaaccgggtgacctatccatgggcaggttgaagtggaggtaaaactccatggaggaccgaacgcacgttcgttgcaatgaccggcgatgacctgtggatagcggtgaaattccaatcgaacccggagatagctggttctccccgaaatagctttagggctagcgttatgttagattaccggaggtaaagcactgaatgggctaggggctgataaagttactgaaccctatcaaactcagaatgccggctaattgatgcatagcagtcagactacgtgagataagtctcgtggtcaaaagggaaacagcccagacccacagctaaggtcccaaataattgctaagtggaaaacgatgtgagattgcccagacaaccaggatgttggcttagaagcagccacacattaaaagagtgcgtaatagctcactggtcgagtggtcttgcgcggaaaatataacggggctaagcagttaaccgaagcttgggcttgccgaaggcaggggtaggggagcgtcgaatacggggtgaagtcgcagcgggagcagcggtggactgtattcgagtgagaatgccggaatgagtagcgagaattatgtgggaatcataatggccgaaaatctaaggtttcctggggaaggttcgtccgcccagggttagccgggagctaaggcgaggccgcgaggcgtagtcgatgcacatacggttgaaattccgtagccaccttatcgaatgaaagctgacacttggaaatagcgg

SEQ ID NO: 2275 - DNA, 464 bp, KLE1738
cctctgtttaccgccattgtagtacgtgtgtagcccaggacataaggggcatgatgatttgacgtcgtccccaccttcctccgttttgtcaacggcagtctcgctagagtgctcttgcgtagcaactaacaataggggttgcgctcgttgcgggacttaacccaacatctcacgacacgagctgacgacaaccatgcaccacctgtcaccacagtctccgaagagaaagaactatctctaattccagccgtgggatgtcaagccctggtaaggttcttcgcgttgcttcgaattaaaccacatactccaccgcttgtgcgggcccccgtcaattcctttgagtttcaaccttgcgatcgtactccccaggtgggatacttattgtgttaactgcggcacggaaggggtcagtccccccacacctagtatccatcgtttacagcgtggactaccagggtatctaa

SEQ ID NO: 2276 - DNA, 1478 bp, KLE1738
gtacgcctatttcattcaacgcacgctgacagagtattgctctgccgggtttccccattcggaaatctccggatcgacggttatttgcacctccccgaagcttatcgcagcttgtcacgtccttcttcggctcctgatgccaaggcattccccttgcgctcttttcagcttgacctactttcttgtgaacaagaaaggtctcgctctggttctcattgagttcgaattatgcaggcttcagagttctttgaaattgttcgtgttacccttaaaaagttccacaaaaatttgttgtttccctctgttgcttgctcttcatactttggttactttgttcagttttcaaggtgcggttctggtctctctcgaaaccagattcaaacacttagcaatcctaaatgcttgaatctaacttcagactatccagttgtctcattttcatcttcgtgaaaatgagtggtgggcccaagtggactcgaaccaccgacctcacgattatcagtcgtgcgctctagccagctgagctatgggcccattggtggagataaacgggttcgaaccgttgaccccctgcttgcaaagcaggtgctctcccagctgagctatacccccatccatctccagggcgtgcgccctctaaattaaacaacgtaagtcgtcaccccgcacccaacgtctgaccttaggacactacaaatagccctcagactacttgagttctccttagaaaggaggtgatccagccgctcgttctcgaacggctaccttgttacgacttcaccccaattatcgaacccaccttcggccgcgccccccttgcggttaggctacggacttcgggtgttcccgactctcatggtgtgacgggcggtgtgtacaaggcccgggaacgtattcaccgcggcatgctgatccgcgattactagcgattccaacttcatacaggcgggttgcagcctgcaatccgaactgggacggcttttaggggtttgctccacctcgcggtcttgcttccctctgtttaccgccattgtagtacgtgtgtagcccaggacataaggggcatgatgatttgacgtcgtccccaccttcctccgttttgtcaacggcagtctcgctagagtgctcttgcgtagcaactaacaataggggttgcgctcgttgcgggacttaacccaacatctcacgacacgagctgacgacaaccatgcaccacctgtcaccacagtccccgaagggaaagaactatctctaattccgtccgtgggatgtcaagccctggtaaggttcttcgcgttgcttcgaattaaaccacatactccaccgcttgtgcgggcccccgtcaattcctttgagtttcaaccttgcgatcgtactccccaggtgggatacttattgtgttaactgcggcacggaaggggtcagtccccccacacctagtatccatcgtttacagcgtggactaccagggtatctaa

SEQ ID NO: 2277 - DNA, 682 bp, KLE1738
aggcgggggtgggggagagaaaggtgtttccccacaacttccggcatttgtttgcccgggcgttttacagcctggagaaggatatggcaaagctggcggaccttttgggacacgccagcgtagagacgactcgaatctatattatggagagcggtgcggagcataaacgccaagtagaacggctgggattggtcatttaacaacaaaattctgattctgttgtagtgtggaggagacctctccctctatcaggggctcatctcccagcacttggcagcgaaacacagaaaaaagacatgagaacgggctggagaaattttttcaggttctccagctccttctcatgtcttcgtttgttttttctcttgatttaagacatgtttttatgctaaaatatgtaaaaatatagttttctctccagacagaacacgctttttcgggaagagtttttcaaatgctaccacaaaatcagaattttgtggtagtgcgtctgtggggaagcgcccacaaagggggtggaggatgcgagagagcttgtatgactactgcacacgaacccgccggcaagcactgctggaagagtgggatgtggaaggcaacggggcactgacgccgttggccctttcccatggcagccgccagaaggtttggtggcgctgcggggcggggcaccggtggcagg

SEQ ID NO: 2278 - DNA, 669 bp, KLE1738
gcgggggtgaaaccggacaaagtatttccccataaccttcggcatctctttgcacggacattttatacccaggagaaggatttgtcccggctggcggatattttgggacacaccagtgtgaataccacccgtatttatactgcggaaagcggcctgattcatgcccggcagatggagcggatggggctgattgtcacataatttctcttatgtggtagttttgatgcgtcaaaagccatagatgtacttaaattgtacaggagacgtagagaaaaagcaagggataccaatgaaaataggaaacaaattttgtttccgggtatgacaaacagaccggacagacctcctgttgcccggccaaattttttatgcctgaaataataaaagcagtgtcgttttccctggcatttagaaccgctgaatccatggattcatggcttggcctctgctatgaccacataagagaaactatgtggtcaaacgccggaaagaagaacaatacaaggaggtaaccatgacatgaaacgaaggttattggcaatggcgctttcgctggttatgctggtggggttattcccaacggcggcgatggcgacggacgatccaggtggaggaaacagcagttcagtctcagccgacacctccacgctaaccacgtgggaagctgtc

SEQ ID NO: 2279 - DNA, 412 bp, KLE1738
actgcatatcgctcagatagttaaaatcacagaaggtcacatcacttgcttcaagcccataatcttctctgatatcaaaaacaagaccaatacgcatagatcatccctccctacctgccgccgcacaagaacgattcataatggggatgacttcccgttcatgtcttatgctggcttcagaaactgattaaacgattgataataagagattatcctcactcctacaacaaagacgggtatgccaaaccgatggcatacccgtctttgtcacgcaaaatgtattttatttctggggtgtttttctaatagaatatcccgctgttttttaccagccacatgggtgtagatttgtgtcgtcaaaatggagctatgcccgagcaaccgttgaatatatcgaatatctacgccttct

SEQ ID NO: 2280 - DNA, 412 bp, KLE1738
actgcatatcgctcagatagttaaaatcacagaaggtcacatcacttgcttcaagcccataatcttctctgatatcaaaaacaagaccaatacgcatagatcatccctccctacctgccgccgcacaagaacgattcataatggggatgacttcccgttcatgtcttatgctggcttcagaaactgattaaacgattgataataagagattatccttataatatattaaattttatcatagtaaggcagaaaaagccagagctttccaaaaatctttcgttcaagtcaaatggcgttgaatgtgggaaagagcctctgaaatattttgaaagacctctcttgcatttataaacaacagtttgaaaatagtctgctggaggataaaaaggagcagcagcgaatcccaatatca

SEQ ID NO: 2281 - DNA, 414 bp, KLE1738
gtgatattgggattcgctgctgctcctttttatcctccagcagactattttcaaactgttgtttataaatgcaagagaggtctttcaaaatatttcagaggctctttcccacattcaacgccatttgacttgaacgaaagatttttggaaagctctggctttttctgccttactatgataaaatttaatatattataaggataatctcttattatcacttattgtggcatcaaataattactatcctttgttacaagcggtaaaataaggtctgatcagactgacaggagtgggagaaatatggaacgccaaaaatatgatgttgcggtttcttacgccagtgaacagcggccttatgtggagcggttcgtcgcacggctgcagtcccaaaaaatgcgtgtatactatgaccga

SEQ ID NO: 2282 - DNA, 412 bp, KLE1738
tgtaaacgatggatactaggtgtggggggactgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccacggctggaattagagatagttctttcccttcggggactgtggtgacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctac

SEQ ID NO: 2283 - DNA, 412 bp, KLE1738
cggtcatagtatacacgcattttttgggactgcagccgtgcgacgaaccgctccacataaggccgctgttcactggcgtaagaaaccgcaacatcatatttttggcgttccatatttctcccactcctgtcagtctgatcagaccttattttaccgcttgtaacaaaggatagtaattatttgatgccacaataagtgataataagagattatcctcactcctacaacaaagacgggtatgccaaaccgatggcatacccgtctttgtcacgcaaaatgtattttatttctggggtgtttttctaatagaatatcccgctgttttttaccagccacatgggtgtagatttgtgtcgtcaaaatggagctatgcccgagcaaccgttgaatatatcgaatatctacgccttct

SEQ ID NO: 2284 - DNA, 377 bp, KLE1738
agttctgctgcccggatgtggatgtgatcaacgtgtttcggattgatgtggagaaggaagaggccgaaacgaaggacttgccaagggaagaaaaatagggtaaaatgaattggaaaaaaggggttgacagcctatgagcgcgagcaatatactcacggcaggcaggcaggcaggcaggcaggcaggcaggcaggcaggcaggcaggcaggcaggcagggtaattcctgccttttagtgctgtctaaaaccgcatattaccagacaaaaaacgtccgccgcgacacagagaaactgtgttgcggtgggcgttttttgcgtgtgtctcagcgtttgtttggggcaaaatgcggcgctgccgcagaaaaggaggaaggtt

SEQ ID NO: 2285 - DNA, 355 bp, KLE1738
agatcatcttggtgatctcggaccgcttaatgttcccctcgggcttataggacccgtcgggatacccgccaatgatgttcagcgcagtgcacatattgacggcctcggtgttctcgatcttgtcctgatccgagaacgccgccccggcgcccatgaccatgacagacagcatcacagccacacagagcaccaggctcagaaccttcttctgggggaatcccttatccatcaatgcttcgctccgcaatttcccacggattttacacggaactcccacaaaactttgcagttattatgtaatgaaaaaggcccaatgaaaacgatcccggtgcctatggtaaagcaccgggatatg

SEQ ID NO: 2286 - DNA, 1051 bp, KLE1738
acggagttttcggacaacggataggaatccttagtggcggacgggtgagtaacgcgtgaggaacctgccttggagaggggaataacacagagaaatttgtgctaataccgcatgatgcagttgggtcgcatggctctgactgccaaagatttatcgctctgagatggcctcgcgtctgattagctagttggcagggtaacggcctaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttatgagggacgaaggaagtgacggtacctcatgaataagctccggctaactacgtgccagcagccgcggtaatacgtagggagcgagcgttatccggatttactgggtgtaaagggcgtgtaggcggggaagcaagtcagatgtgaaaaccagtggctcaaccactggcctgcatttgaaactgtttttcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgctgtaaacgatggatactaggtgtggggggactgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccacggctggaattagagatagttctttcccttcggagactgtggtgacaggtggtgcatggttgtcgtcagctcgtgtcgtgagatgttgggttaagtcccgcaacgagcgcaacccctattgttagttgctacgcaa

SEQ ID NO: 2287 - DNA, 20 bp, Artificial Sequence
  Synthetic Construct
agagtttgatcmtggctcag

SEQ ID NO: 2288 - DNA, 22 bp, Artificial Sequence
  Synthetic Construct
tacggytaccttgttacgactt
